United States Patent
Gray et al.

(10) Patent No.: US 10,532,110 B2
(45) Date of Patent: Jan. 14, 2020

(54) AAV VECTORS TARGETED TO THE CENTRAL NERVOUS SYSTEM

(71) Applicant: The University of North Carolina at Chapel Hill, Chapel Hill, NC (US)

(72) Inventors: Steven Gray, Mebane, NC (US); Thomas McCown, Carrboro, NC (US)

(73) Assignee: The University of North Carolina at Chapel Hill, Chapel Hill, NC (US)

( * ) Notice: Subject to any disclaimer, the term of this patent is extended or adjusted under 35 U.S.C. 154(b) by 352 days.

(21) Appl. No.: 15/525,214

(22) PCT Filed: Nov. 20, 2015

(86) PCT No.: PCT/US2015/061788
§ 371 (c)(1),
(2) Date: May 8, 2017

(87) PCT Pub. No.: WO2016/081811
PCT Pub. Date: May 26, 2016

(65) Prior Publication Data
US 2017/0360960 A1 Dec. 21, 2017

Related U.S. Application Data

(60) Provisional application No. 62/082,897, filed on Nov. 21, 2014, provisional application No. 62/218,857, filed on Sep. 15, 2015.

(51) Int. Cl.
| | |
|---|---|
| *A61K 48/00* | (2006.01) |
| *A61K 9/00* | (2006.01) |
| *C12N 7/00* | (2006.01) |
| *C12N 15/86* | (2006.01) |
| *A61K 35/76* | (2015.01) |
| *C07K 14/005* | (2006.01) |
| *C12N 15/62* | (2006.01) |
| *A61K 31/711* | (2006.01) |

(52) U.S. Cl.
CPC ........ *A61K 48/0058* (2013.01); *A61K 9/0014* (2013.01); *A61K 31/711* (2013.01); *A61K 35/76* (2013.01); *C07K 14/005* (2013.01); *C12N 7/00* (2013.01); *C12N 15/62* (2013.01); *C12N 15/86* (2013.01); *C12N 2750/14121* (2013.01); *C12N 2750/14122* (2013.01); *C12N 2750/14143* (2013.01); *C12N 2750/14145* (2013.01); *C12N 2750/14151* (2013.01); *C12N 2830/008* (2013.01)

(58) Field of Classification Search
None
See application file for complete search history.

(56) References Cited

U.S. PATENT DOCUMENTS

| | | | |
|---|---|---|---|
| 6,582,692 B1 | 6/2003 | Podsakoff et al. | |
| 7,906,111 B2 | 3/2011 | Wilson et al. | |
| 9,926,574 B2 | 3/2018 | Barkats | |
| 10,208,318 B2 | 2/2019 | Barkats | |
| 10,301,648 B2 | 5/2019 | Vandenberghe et al. | |
| 2003/0083299 A1 | 5/2003 | Ferguson | |
| 2005/0014262 A1 | 1/2005 | Gao et al. | |
| 2009/0202490 A1 | 8/2009 | Schaffer et al. | |
| 2013/0225666 A1 | 8/2013 | Kaspar et al. | |

FOREIGN PATENT DOCUMENTS

| | | |
|---|---|---|
| EP | 1620133 | 2/2006 |
| WO | WO 2005/033321 A2 | 4/2005 |
| WO | 2007/089632 A2 | 8/2007 |
| WO | WO 2011/133890 A1 | 10/2011 |
| WO | 2014/052789 A1 | 4/2014 |

OTHER PUBLICATIONS

Notification of Transmittal of the International Search Report and the Written Opinion of the International Searching Authority, or the Declaration corresponding to International Application No. PCT/US2015/061788 dated Apr. 14, 2016.
Notification Concerning Transmittal of International Preliminary Report on Patentability corresponding to Internationai Application No. PCT/US2015/061788 dated Jun. 1, 2017.
Supplementary Partial European Search Report corresponding to European Application No. 15861347.1 dated May 28, 2018.
Gray et al. "Directed Evolution of a Novel Adeno-associated Virus (AAV) Vector that Crosses the Seizure-compromised Blood-Brain Barrier (BBB)", Molecular Therapy 18(3):570-578 (2010).
Gray "Gene therapy and neurodevelopment disorders", Neuropharmacology 68:136-142 (2013).
Koerber et al. "Molecular Evolution of Adeno-associated Virus for Enhanced Glial Gene Delivery", Molecular Therapy: The Journal of the American Society of Gene Therapy 17(12):2088-2095 (2009).
Maguire et al. "Directed evolution of adeno-associated virus for glioma cell transduction", J. Neurooncol. 96(3):337-347 (2010).
Powell et al. "Characterization of a novel adeno-associated viral vector with preferential oligodendrocyte tropism", Gene Therapy 23(11):807-814 (2016).
Yang et al. "Global CNS Transduction of Adult Mice by Intravenously Delivered rAAVrh.8 and rAAVrh.10 and Nonhuman Primates by rAAVrh.10", Molecular Therapy: The Journal of the American Society of Gene Therapy 22(7):1299-1309 (2014).
U.S. Appl. No. 16/440,638; office action dated Sep. 18, 2019.
Perabo et al., "Combinatorial engineering of a gene therapy vector: directed evolution of adeno-associated virus", J Gene Med 8:155-162 (2006).
Xiao et al. Gene Therapy Vectors Based on Adeno-Associated Virus Type 1:, J. Virology 73(5):3994-4003 (1999).
Extended European Search Report corresponding to European Application No. 15861347.1 dated Aug. 13, 2018.
Hutson et al. "Corticospinal tract transduction: a comparison of seven adeno-associated viral vector serotypes and a non-integrating lentiviral vector", Gene Therapy 19:49-60 (2012).
Wu et al. "Single Amino Acid Changes Can Influence Titer, Heparin Binding, and Tissue Tropism in Different Adeno-Associated Virus Serotypes", J Virology 80(22):11393-11397 (2006).

*Primary Examiner* — James D Schultz
(74) *Attorney, Agent, or Firm* — Myers Bigel, P.A.

(57) ABSTRACT

The invention relates to chimeric AAV capsids targeted to the central nervous system, virus vectors comprising the same, and methods of using the vectors to target the central nervous system. The invention further relates to chimeric AAV capsids targeted to oligodendrocytes, virus vectors comprising the same, and methods of using the vectors to target oligodendrocytes.

24 Claims, 16 Drawing Sheets
Specification includes a Sequence Listing.

FIGS. 10A-10E
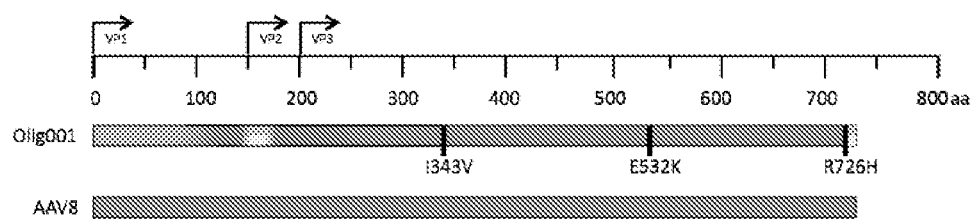
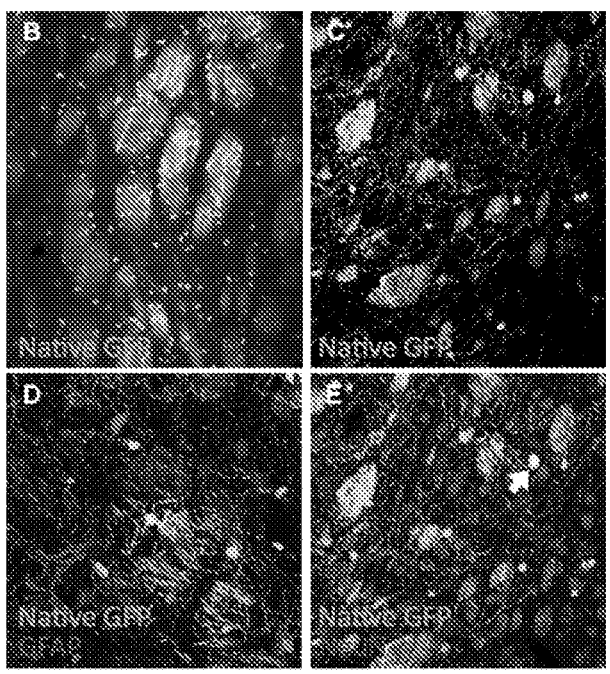

FIGS. 12A-12G
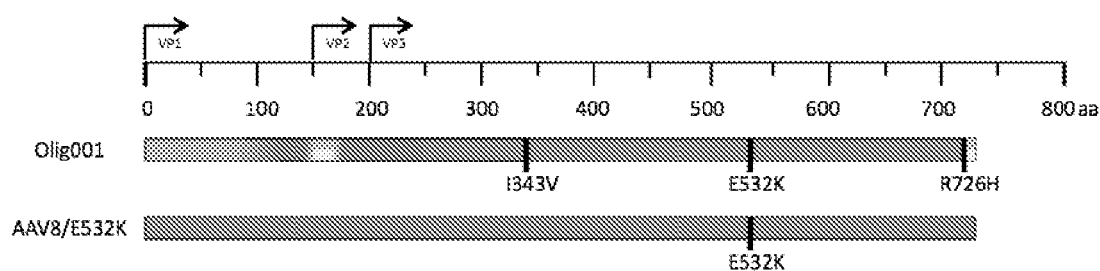
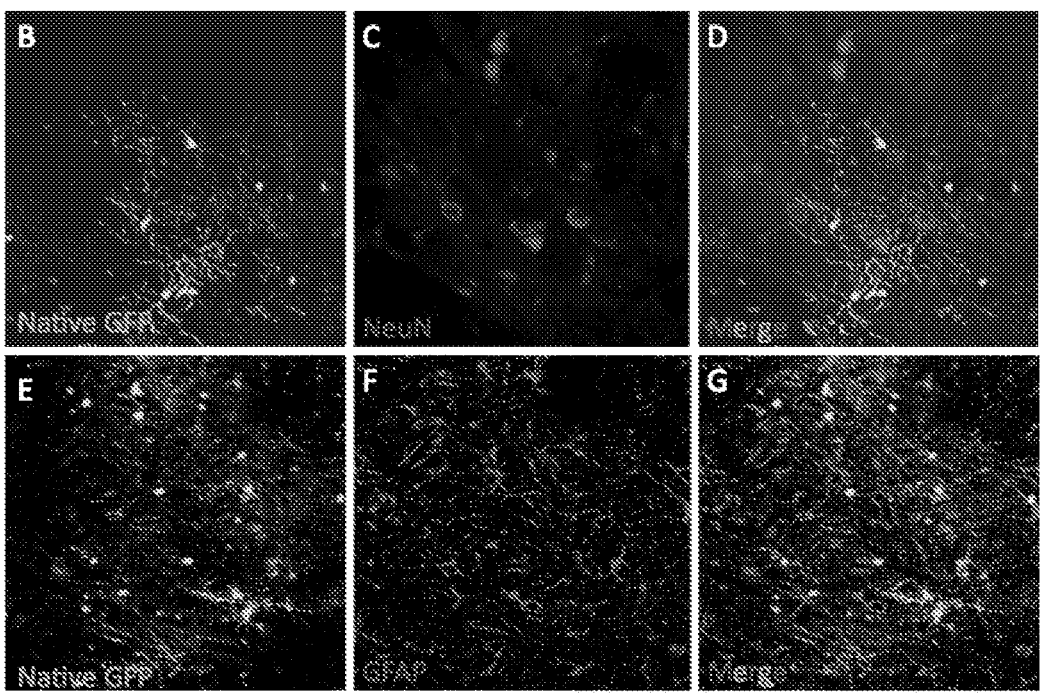

FIGS. 13A-13G
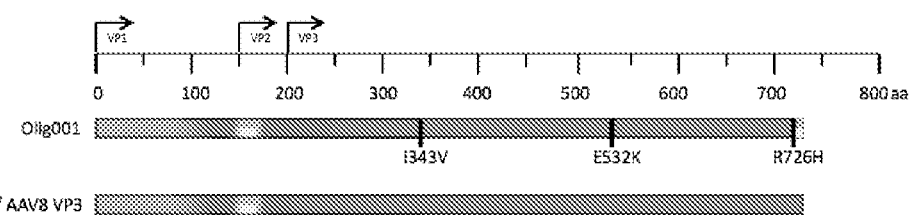
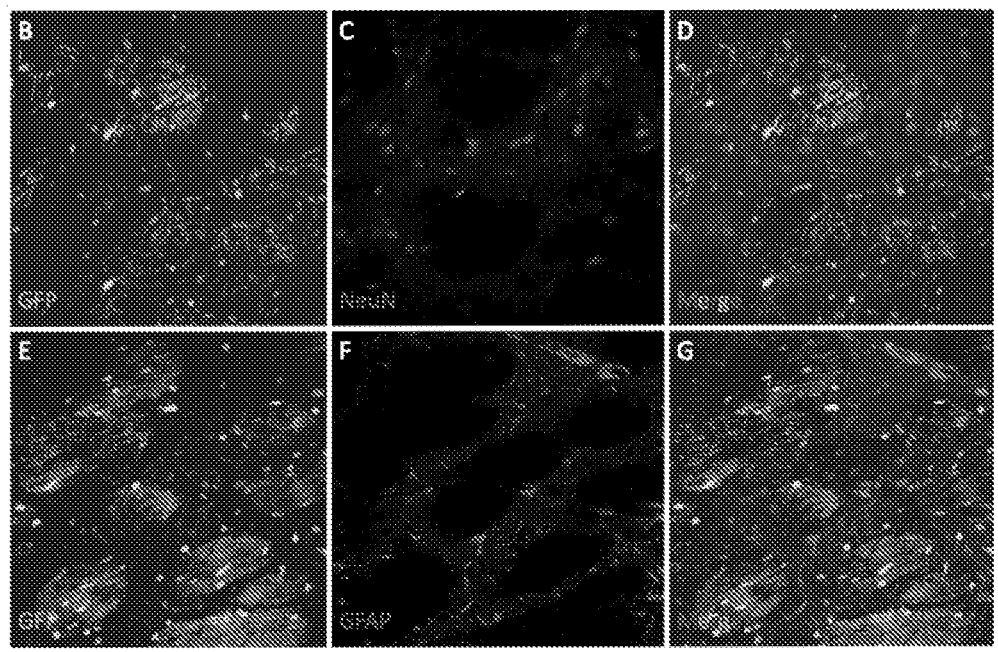

A

B

AAV VECTORS TARGETED TO THE CENTRAL NERVOUS SYSTEM

STATEMENT OF PRIORITY

This application is a 35 U.S.C. § 371 national phase application of PCT/US2015/061788, filed Nov. 20, 2015, which claims the benefit of U. S. Provisional Patent Application Ser. No. 62/082,897, filed Nov. 21, 2014 and U.S. Provisional Patent Application Ser. No. 62/218,857, filed Sep. 15, 2015, the entire contents of each of which are incorporated by reference herein.

STATEMENT REGARDING ELECTRONIC FILING OF A SEQUENCE LISTING

A Sequence Listing in ASCII text format, submitted under 37 C.F.R. § 1.821, entitled 5470-718_ST25.txt, 638,534 bytes in size, generated on May 5, 2017 and filed via EFS-Web, is provided in lieu of a paper copy. This Sequence Listing is hereby incorporated by reference into the specification for its disclosures.

FIELD OF THE INVENTION

The invention relates to chimeric AAV capsids targeted to the central nervous system, virus vectors comprising the same, and methods of using the vectors to target the central nervous system. The invention further relates to chimeric AAV capsids targeted to oligodendrocytes, virus vectors comprising the same, and methods of using the vectors to target oligodendrocytes.

BACKGROUND OF THE INVENTION

Adeno-associated virus (AAV) was first reported to efficiently transduce muscle over ten years ago (Xiao et al., (1996) *J. Virol.* 70:8098-8108). The recombinant AAV (rAAV) genome composed of a foreign expression cassette and AAV inverted terminal repeat (ITR) sequences exists in eukaryotic cells in an episomal form that is responsible for persistent transgene expression (Schnepp et al., (2003) *J. Virol.* 77:3495-3504). AAV vectors have a good safety profile. No human disease has been associated with wild-type AAV infection and low toxicity is observed in human subjects following transduction by rAAV (Marino et al., (2003) *Blood* 101:2963-2972).

AAV vectors have been used in clinical trials for central nervous system (CNS) disorders. While some success have been garnered, naturally-occurring AAV capsids lack specificity for the CNS and are unsuitable for certain disease applications. Recent advances in AAV engineering and directed evolution have expanded the ability to develop novel AAV serotypes, including vectors with altered tropism (Gray et al., (2010) *Mol. Ther.* 18:570-578). However, no AAV vectors have been capable of widespread CNS gene transfer with minimal tropism for peripheral organs.

In the brain, the vast majority of AAV vectors exhibit a dominant preference for neurons with a very low efficacy for ether cell types, such as oligodendrocytes. AAV vectors that efficiently target oligodendrocytes have not been developed.

SUMMARY OF THE INVENTION

The present invention is based, in part, on the development of chimeric AAV capsid sequences that are capable of widespread CNS gene transfer after delivery to the CNS with minimal tropism for peripheral organs. The invention further relates to chimeric AAV capsids that have enhanced transduction capabilities in subjects with Rett Syndrome. The chimeric capsids can be used to create AAV vectors for use in research or therapeutic applications where widespread CNS gene transfer is desired without extensive vector biodistribution to peripheral organs.

The present invention further is based, in part, on the development of chimeric AAV capsid sequences that are capable of oligodendrocyte-preferred or specific gene transfer after delivery to the CNS with minimal tropism for peripheral organs. The chimeric capsids can be used to create AAV vectors for use in research or therapeutic applications where oligodendrocyte gene transfer is desired without extensive vector biodistribution to neurons or to peripheral organs.

Thus, one aspect of the invention relates to a nucleic acid encoding an AAV capsid, the nucleic acid comprising an AAV capsid coding sequence that is at least 70% identical to: (a) the nucleotide sequence of any one of SEQ ID NOS:1-43; or (b) a nucleotide sequence encoding any one of SEQ ID NOS:44-86, along with cells and viral particles comprising the nucleic acid.

Thus, one aspect of the invention relates to a nucleic acid encoding an AAV capsid, the nucleic acid comprising an AAV capsid coding sequence that is at least 70% identical to: (a) the nucleotide sequence of any one of SEQ ID NOS: 87-107; or (b) a nucleotide sequence encoding any one of SEQ ID NOS: 108-128, along with cells and viral particles comprising the nucleic acid.

Another aspect of the invention relates to an AAV capsid comprising an amino acid sequence at least 90% identical to any one of SEQ ID NOS:44-86, along with AAV particles comprising an AAV vector genome and the AAV capsid of the invention.

Another aspect of the invention relates to an AAV capsid comprising an amino acid sequence at least 90% identical to any one of SEQ ID NOS: 108-128, along with AAV particles comprising an AAV vector genome and the AAV capsid of the invention.

A further aspect of the invention relates to a method of producing a recombinant AAV particle comprising an AAV capsid, the method comprising: providing a cell in vitro with a nucleic acid of the invention, an AAV rep coding sequence, an AAV vector genome comprising a heterologous nucleic acid, and helper functions for generating a productive AAV infection; and allowing assembly of the recombinant AAV particle comprising the AAV capsid and encapsidating the AAV vector genome.

An additional aspect of the invention relates to a pharmaceutical formulation comprising the nucleic acid, virus particle, AAV capsid, or AAV particle of the invention in a pharmaceutically acceptable carrier.

Another aspect of the invention relates to a method of delivering a nucleic acid of interest to a CNS cell, the method comprising contacting the cell with the AAV particle of the invention.

A further aspect of the invention relates to a method of delivering a nucleic acid of interest to a CNS cell in a mammalian subject, the method comprising administering an effective amount of the AAV particle or pharmaceutical formulation of the invention to a mammalian subject.

An additional aspect of the invention relates to a method of delivering a nucleic acid of interest to an area of the CNS bordering a compromised blood brain barrier area in a mammalian subject, the method comprising intravenously administering an effective amount of the AAV particle or pharmaceutical formulation of the invention to a mammalian subject.

Another aspect of the invention relates to a method of treating a disorder associated with CNS dysfunction in a mammalian subject in need thereof, the method comprising administering a therapeutically effective amount of the AAV particle or pharmaceutical formulation of the invention to a mammalian subject.

Another aspect of the invention relates to a method of treating Rett Syndrome in a mammalian subject in need thereof, the method comprising administering a therapeutically effective amount of the AAV particle or pharmaceutical formulation of the invention to a mammalian subject.

A further aspect of the invention relates to a method of preparing an AAV capsid having a tropism profile of interest, the method comprising modifying the AAV capsid of the invention to insert an amino acid sequence providing the tropism profile of interest.

One aspect of the invention relates to a nucleic acid encoding an AAV capsid, the nucleic acid comprising an AAV capsid coding sequence that is at least 70% identical to: (a) the nucleotide sequence of any one of SEQ ID NO:129; or (b) a nucleotide sequence encoding any one of SEQ ID NOS:130-132, along with cells and viral particles comprising the nucleic acid.

Another aspect of the invention relates to an AAV capsid comprising an amino acid sequence at least 90% identical to any one of SEQ ID NOS:130-132, along with AAV particles comprising an AAV vector genome and the AAV capsid of the invention.

Another aspect of the invention relates to a method of delivering a nucleic acid of interest to an oligodendrocyte, the method comprising contacting the cell with the AAV particle of the invention.

A further aspect of the invention relates to a method of delivering a nucleic acid of interest to an oligodendrocyte in a mammalian subject, the method comprising administering an effective amount of the AAV particle or pharmaceutical formulation of the invention to a mammalian subject.

Another aspect of the invention relates to a method of treating a disorder associated with oligodendrocyte dysfunction in a mammalian subject in need thereof, the method comprising administering a therapeutically effective amount of the AAV particle or pharmaceutical formulation of the invention to a mammalian subject.

A further aspect of the invention relates to a nucleic acid encoding an AAV8 capsid comprising an E532K substitution, along with cells and viral particles comprising the nucleic acid.

Another aspect of the invention relates to an AAV8 capsid comprising an E532K substitution, along with AAV particles comprising an AAV vector genome and the AAV capsid of the invention.

Another aspect of the invention relates to a method of delivering a nucleic acid of interest to an oligodendrocyte, the method comprising contacting the cell with the AAV particle of the invention.

A further aspect of the invention relates to a method of delivering a nucleic acid of interest to an oligodendrocyte in a mammalian subject, the method comprising administering an effective amount of the AAV particle or pharmaceutical formulation of the invention to a mammalian subject.

Another aspect of the invention relates to a method of treating a disorder associated with oligodendrocyte dysfunction in a mammalian subject in need thereof, the method comprising administering a therapeutically effective amount of the AAV particle or pharmaceutical formulation of the invention to a mammalian subject.

These and other aspects of the invention are set forth in more detail in the description of the invention below.

BRIEF DESCRIPTION OF THE DRAWINGS

FIGS. 10A-10E shows that Olig001 has an oligodendrocyte preferring tropism. (A) Diagram of the cap gene from Olig001 compared to AAV8. The different colors represent a different AAV parental serotype (blue=AAV2, purple=AAV8, red=AAV9, yellow=AAV1, and orange=AAV6) present in the input reaction of the library. The black vertical bars indicate point mutations. (13) Olig001 transduction of cells in the rat striatum that exhibit characteristics indicative of oligodendrocytes including the localization of GFP positive myelin in the patch of the striatal patch/matrix. (C) Confocal image at a higher magnification of the transduced cells that again reflects the unique morphology of CNS oligodendrocytes. (D) Confocal image reveals a lack of co-localization of the GFP positive cells with astrocytes labeled with GFAP (red) within the striatum. (E) Confocal image illustrates that the vast majority of Olig001 transduced cells within the striatum do not co-localize with a marker of neurons, NeuN (red). However, the arrow in indicates a single GFP/NeuN positive cell.

FIGS. 12A-12G shows that AAV8 with an E532K mutation is oligotropic. (A) Diagram of the cap gene from Olig001 compared to AAV8/E532K. The different colors represent a different AAV parental serotype (blue=AAV2, purple=AAV8, red=AAV9, yellow=AAV1, and orange=AAV6). The black vertical bars indicate point mutations. AAV8/E532K was packaged with CBh-GFP, and $2\times10^8$ vg was intracranially injected into the striatum of wild-type male Sprague-Dawley rats. Two weeks post injection the rats were transcardially perfused and their brains fixed and sectioned coronally. (B-D) Confocal images of the striatum indicate that GFP positive cells lack co-localization with neuronal (NeuN) markers. (E-G) Confocal images of the striatum indicate that GFP positive cells lack co-localization and astrocyte (GFAP) marker.

FIGS. 13A-13G show that Olig001 oligodendrocyte preferring tropism is independent of VP3 sequence. (A) Diagram of the cap gene from Olig001 compared to Olig001/AAV VP3. The different colors represent a different AAV parental serotype (blue=AAV2, purple=AAV8, red=AAV9, yellow=AAV1, and orange=AAV6). The black vertical bars indicate point mutations. Mutant Olig001 with VP3 of AAV8 (Olig001/AAV8 VP3) was packaged with CBh-GFP at a titer of 2×10$^8$ vg/µl and intracranially injected into the striatum of wild-type male Sprague-Dawley rats. Two weeks later the rats were transcardially perfused and their brains fixed and sectioned coronally. (B-D) Confocal images of the striatum indicate that GFP positive cells exhibit striatal oligodendrocyte morphology and lack co-localization with neuronal (NeuN) markers. (E-G) Confocal images of the striatum indicate that GFP positive cells exhibit striatal oligodendrocyte morphology and lack co-localization and astrocyte (GFAP) marker.

DETAILED DESCRIPTION OF THE INVENTION

Figure 1:
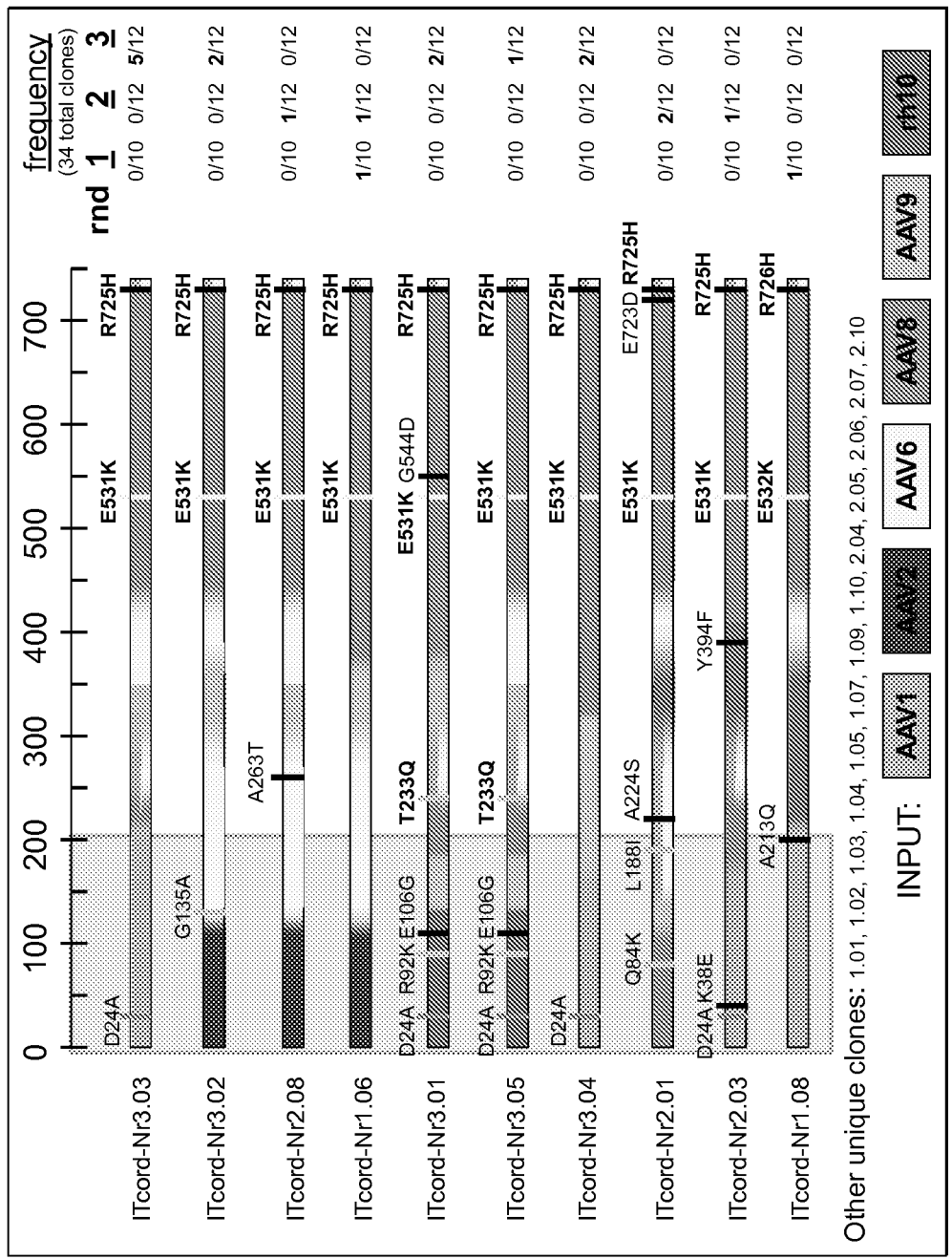
FIG. 1 shows the chimeric structure of AAV capsid clones isolated from the spinal cord of wild-type mice.

The present invention is based, in part, on the development of chimeric AAV capsid sequences that are capable of widespread CNS gene transfer after delivery to the CNS with minimal tropism for peripheral organs. The invention further relates to chimeric AAV capsids that have enhanced transduction capabilities in subjects with Rett Syndrome. The chimeric capsids can be used to create AAV vectors for use in research or therapeutic applications where widespread CNS gene transfer is desired without extensive vector biodistribution to peripheral organs.

The present invention further is based, in part, on the development of chimeric AAV capsid sequences that are capable of oligodendrocyte-preferred or specific gene transfer after delivery to the CNS with minimal tropism for peripheral organs. The chimeric capsids can be used to create AAV vectors for use in research or therapeutic applications where oligodendrocyte gene transfer is desired without extensive vector biodistribution to neurons or to peripheral organs.

The present invention is explained in greater detail below. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments suggested herein will be apparent to those skilled in the art in light of the instant disclosure which do not depart from the instant invention. Hence, the following specification is intended to illustrate some particular embodiments of the invention, and not to exhaustively specify all permutations, combinations and variations thereof.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a complex comprises components A, B and C, it is specifically intended that any of A, B or C, or a combination thereof, can be omitted and disclaimed singularly or in any combination.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

Nucleotide sequences are presented herein by single strand only, in the 5' to 3' direction, from left to right, unless specifically indicated otherwise. Nucleotides and amino acids are represented herein in the manner recommended by the IUPAC-IUB Biochemical Nomenclature Commission, or (for amino acids) by either the one-letter code, or the three letter code, both in accordance with 37 C.F.R. § 1.822 and established usage.

Except as otherwise indicated, standard methods known to those skilled in the art may be used for production of recombinant and synthetic polypeptides, antibodies or antigen-binding fragments thereof, manipulation of nucleic acid sequences, production of transformed cells, the construction of rAAV constructs, modified capsid proteins, packaging vectors expressing the AAV rep and/or cap sequences, and transiently and stably transfected packaging cells. Such techniques are known to those skilled in the art. See, e.g., SAMBROOK et al., MOLECULAR CLONING: A LABORATORY MANUAL 2nd Ed. (Cold Spring Harbor, N.Y., 1989); F. M. AUSUBEL et al. CURRENT PROTOCOLS IN MOLECULAR BIOLOGY (Green Publishing Associates, Inc. and John Wiley & Sons, Inc., New York).

All publications, patent applications, patents, nucleotide sequences, amino acid sequences and other references mentioned herein are incorporated by reference in their entirety.

I. Definitions

The designation of all amino acid positions in the AAV capsid subunits in the description of the invention and the appended claims is with respect to VP1 capsid subunit numbering.

As used in the description of the invention and the appended claims, the singular forms "a," "an" and "the" are intended to include the plural forms as well, unless the context clearly indicates otherwise.

As used herein, "and/or" refers to and encompasses any and all possible combinations of one or more of the associated listed items, as well as the lack of combinations when interpreted in the alternative ("or").

Moreover, the present invention also contemplates that in some embodiments of the invention, any feature or combination of features set forth herein can be excluded or omitted.

Furthermore, the term "about," as used herein when referring to a measurable value such as an amount of a compound or agent of this invention, dose, time, temperature, and the like, is meant to encompass variations of ±20%, ±10%, ±5%, ±1%, ±0.5%, or even ±0.1% of the specified amount.

The term "consisting essentially of" as used herein in connection with a nucleic acid, protein or capsid structure means that the nucleic acid, protein or capsid structure does not contain any element other than the recited element(s) that significantly alters (e.g., more than about 1%, 5% or 10%) the function of interest of the nucleic acid, protein or capsid structure, e.g., tropism profile of the protein or capsid or a protein or capsid encoded by the nucleic acid.

The term "adeno-associated virus" (AAV) in the context of the present invention includes without limitation AAV type 1, AAV type 2, AAV type 3 (including types 3A and 3B), AAV type 4, AAV type 5, AAV type 6, AAV type 7, AAV type 8, AAV type 9, AAV type 10, AAV type 11, avian AAV, bovine AAV, canine AAV, equine AAV, and ovine AAV and any other AAV now known or later discovered. See, e.g., BERNARD N. FIELDS et al., VIROLOGY, volume 2, chapter 69 (4th ed., Lippincott-Raven Publishers). A number of additional AAV serotypes and clades have been identified (see, e.g., Gao et al., (2004) *J. Virol.* 78:6381-6388 and Table 1), which are also encompassed by the term "AAV."

The genomic sequences of various AAV and autonomous parvoviruses, as well as the sequences of the ITRs, Rep proteins, and capsid subunits are known in the art. Such sequences may be found in the literature or in public databases such as the GenBank® database. See, e.g., GenBank® Accession Numbers NC 002077, NC 001401, NC 001729, NC 001863, NC 001829, NC 001862, NC 000883, NC 001701, NC 001510, AF063497, U89790, AF043303, AF028705, AF028704, J02275, J01901, J02275, X01457, AF288061, AH009962, AY028226, AY028223, NC 001358, NC 001540, AF513851, AF513852, AY530579, AY631965, AY631966; the disclosures of which are incorporated herein in their entirety. See also, e.g., Srivistava et al., (1983) *J. Virol.* 45:555; Chiorini et al., (1998) *J. Virol.* 71:6823; Chiorini et al., (1999) *J. Virol.* 73:1309; Bantel-Schaal et al., (1999) *J. Virol.* 73:939; Xiao et al., (1999) *J. Virol.* 73:3994; Muramatsu et al., (1996) *Virology* 221:208; Shade et al., (1986) *J. Virol.* 58:921; Gao et al., (2002) *Proc. Nat. Acad. Sci. USA* 99:11854; international patent publications WO 00/28061, WO 99/61601, WO 98/11244; U.S. Pat. No. 6,156,303; the disclosures of which are incorporated herein in their entirety. See also Table 1. An early description of the AAV1, AAV2 and AAV3 terminal repeat sequences is provided by Xiao, X., (1996), "Characterization of Adeno-associated virus (AAV) DNA replication and integration," Ph.D. Dissertation, University of Pittsburgh, Pittsburgh, Pa. (incorporated herein it its entirety).

TABLE 1

| Complete Genomes | GenBank Accession Number |
|---|---|
| Adeno-associated virus 1 | NC_002077, AF063497 |
| Adeno-associated virus 2 | NC_001401 |
| Adeno-associated virus 3 | NC_001729 |
| Adeno-associated virus 3B | NC_001863 |
| Adeno-associated virus 4 | NC_001829 |
| Adeno-associated virus 5 | Y18065, AF085716 |
| Adeno-associated virus 6 | NC_001862 |
| Avian AAV ATCC VR-865 | AY186198, AY629583, NC_004828 |
| Avian AAV strain DA-1 | NC_006263, AY629583 |
| Bovine AAV | NC_005889, AY388617 |
| Clade A | |
| AAV1 | NC_002077, AF063497 |
| AAV6 | NC_001862 |
| Hu.48 | AY530611 |
| Hu 43 | AY530606 |
| Hu 44 | AY530607 |
| Hu 46 | AY530609 |
| Clade B | |
| Hu. 19 | AY530584 |
| Hu. 20 | AY530586 |
| Hu 23 | AY530589 |
| Hu22 | AY530588 |
| Hu24 | AY530590 |
| Hu21 | AY530587 |
| Hu27 | AY530592 |
| Hu28 | AY530693 |
| Hu 29 | AY530594 |
| Hu63 | AY530624 |
| Hu64 | AY530625 |
| Hu13 | AY530578 |
| Hu56 | AY530618 |
| Hu57 | AY530619 |
| Hu49 | AY530612 |
| Hu58 | AY530620 |
| Hu34 | AY530598 |
| Hu35 | AY530599 |
| AAV2 | NC_001401 |
| Hu45 | AY530608 |
| Hu47 | AY530610 |
| Hu51 | AY530613 |
| Hu52 | AY530614 |
| Hu T41 | AY695378 |
| Hu S17 | AY695376 |
| Hu T88 | AY695375 |
| Hu T71 | AY695374 |
| Hu T70 | AY695373 |
| Hu T40 | AY695372 |
| Hu T32 | AY695371 |
| Hu T17 | AY695370 |
| Hu LG15 | AY695377 |
| Clade C | |
| Hu9 | AY530629 |
| Hu10 | AY530576 |
| Hu11 | AY530577 |
| Hu53 | AY530615 |
| Hu55 | AY530617 |
| Hu54 | AY530616 |
| Hu7 | AY530628 |
| Hu18 | AY530583 |
| Hu15 | AY530580 |
| Hu16 | AY530581 |

TABLE 1-continued

| Complete Genomes | GenBank Accession Number |
|---|---|
| Hu25 | AY530591 |
| Hu60 | AY530622 |
| Ch5 | AY243021 |
| Hu3 | AY530595 |
| Hu1 | AY530575 |
| Hu4 | AY530602 |
| Hu2 | AY530585 |
| Hu61 | AY530623 |
| Clade D | |
| Rh62 | AY530573 |
| Rh48 | AY530561 |
| Rh54 | AY530567 |
| Rh55 | AY530568 |
| Cy2 | AY243020 |
| AAV7 | AF513851 |
| Rh35 | AY243000 |
| Rh37 | AY242998 |
| Rh36 | AY242999 |
| Cy6 | AY243016 |
| Cy4 | AY243018 |
| Cy3 | AY243019 |
| Cy5 | AY243017 |
| Rh13 | AY243013 |
| Clade E | |
| Rh38 | AY530558 |
| Hu66 | AY530626 |
| Hu42 | AY530605 |
| Hu67 | AY530627 |
| Hu40 | AY530603 |
| Hu41 | AY530604 |
| Hu37 | AY530600 |
| Rh40 | AY530559 |
| Rh2 | AY243007 |
| Bb1 | AY243023 |
| Bb2 | AY243022 |
| Rh10 | AY243015 |
| Hu17 | AY530582 |
| Hu6 | AY530621 |
| Rh25 | AY530557 |
| Pi2 | AY530554 |
| Pi1 | AY530553 |
| Pi3 | AY530555 |
| Rh57 | AY530569 |
| Rh50 | AY530563 |
| Rh49 | AY530562 |
| Hu39 | AY530601 |
| Rh58 | AY530570 |
| Rh61 | AY530572 |
| Rh52 | AY530565 |
| Rh53 | AY530566 |
| Rh51 | AY530564 |
| Rh64 | AY530574 |
| Rh43 | AY530560 |
| AAV8 | AF513852 |
| Rh8 | AY242997 |
| Rh1 | AY530556 |
| Clade F | |
| Hu14 (AAV9) | AY530579 |
| Hu31 | AY530596 |
| Hu32 | AY530597 |
| Clonal Isolate | |
| AAV5 | Y18065, AF085716 |
| AAV 3 | NC_001729 |
| AAV 3B | NC_001863 |
| AAV4 | NC_001829 |
| Rh34 | AY243001 |
| Rh33 | AY243002 |
| Rh32 | AY243003 |

A "chimeric" AAV nucleic acid capsid coding sequence or AAV capsid protein is one that combines portions of two or more capsid sequences. A "chimeric" AAV virion or particle comprises a chimeric AAV capsid protein.

The term "tropism" as used herein refers to preferential entry of the virus into certain cell or tissue type(s) and/or preferential interaction with the cell surface that facilitates entry into certain cell or tissue types, optionally and preferably followed by expression (e.g., transcription and, optionally, translation) of sequences carried by the viral genome in the cell, e.g., for a recombinant virus, expression of the heterologous nucleotide sequence(s). Those skilled in the art will appreciate that transcription of a heterologous nucleic acid sequence from the viral genome may not be initiated in the absence of trans-acting factors, e.g., for an inducible promoter or otherwise regulated nucleic acid sequence. In the case of a rAAV genome, gene expression from the viral genome may be from a stably integrated provirus and/or from a non-integrated episome, as well as any other form which the virus nucleic acid may take within the cell.

The term "tropism profile" refers to the pattern of transduction of one or more target cells, tissues and/or organs. Representative examples of chimeric AAV capsids have a tropism profile characterized by efficient transduction of cells of the CNS with only low transduction of peripheral organs.

The term "specific for cells of the CNS" as used herein refers to a viral vector that, when administered directly into the CNS, preferentially transduces all cell types in the CNS with minimal transduction of cells outside the CNS. In some embodiments, at least about 80% of the transduced cells are CNS cells, e.g., at least about 85%, 90%, 95%, 96%, 97%, 98%, 99% or more CNS cells.

The term "disorder associated with CNS dysfunction" as used herein refers to a disease, disorder, or injury in which CNS cells are damaged, lost, or function improperly. The term includes diseases, disorders, and injuries in which CNS cells are directly affected as well as diseases, disorders, and injuries in which CNS cells become dysfunctional secondary to damage to other cells (e.g., myocardial infarction or stroke).

The term "specific for oligodendrocytes" as used herein refers to a viral vector that, when administered directly into the CNS, preferentially transduces oligodendrocytes over neurons, astrocytes, and other CNS cell types. In some embodiments, at least about 80% of the transduced cells are oligodendrocytes, e.g., at least about 85%, 90%, 95%, 96%, 97%, 98%, 99% or more oligodendrocytes.

The term "disorder associated with oligodendrocyte dysfunction" as used herein refers to a disease, disorder, or injury in which oligodendrocytes are damaged, lost, or function improperly. The term includes diseases, disorders, and injuries in which oligodendrocytes are directly affected as well as diseases, disorders, and injuries in which oligodendrocytes become dysfunctional secondary to damage to other cells (e.g., spinal cord injury).

The term "bordering a compromised blood-brain barrier area" as used herein refers to CNS cells that are adjacent to a portion of the blood-brain barrier in which the barrier function has been compromised.

As used herein, "transduction" of a cell by a virus vector (e.g., an AAV vector) means entry of the vector into the cell and transfer of genetic material into the cell by the incorporation of nucleic acid into the virus vector and subsequent transfer into the cell via the virus vector.

Unless indicated otherwise, "efficient transduction" or "efficient tropism," or similar terms, can be determined by reference to a suitable positive or negative control (e.g., at least about 50%, 60%, 70%, 80%, 85%, 90%, 95% or more of the transduction or tropism, respectively, of a positive control or at least about 110%, 120%, 150%, 200%, 300%, 500%, 1000% or more of the transduction or tropism, respectively, of a negative control).

Similarly, it can be determined if a virus "does not efficiently transduce" or "does not have efficient tropism" for a target tissue, or similar terms, by reference to a suitable control. In particular embodiments, the virus vector does not efficiently transduce (i.e., does not have efficient tropism far) tissues outside the CNS, e.g., liver, kidney, gonads and/or germ cells. In particular embodiments, undesirable transduction of tissue(s) (e.g., liver) is 20% or less, 10% or less, 5% or less, 1% or less, 0.1% or less of the level of transduction of the desired target tissue(s) (e.g., CNS cells).

As used herein, the term "polypeptide" encompasses both peptides and proteins, unless indicated otherwise.

A "nucleic acid" or "nucleotide sequence" is a sequence of nucleotide bases, and may be RNA, DNA or DNA-RNA hybrid sequences (including both naturally occurring and non-naturally occurring nucleotide), but is preferably either single or double stranded DNA sequences.

As used herein, an "isolated" nucleic acid or nucleotide sequence (e.g., an "isolated DNA" or an "isolated RNA") means a nucleic acid or nucleotide sequence separated or substantially free from at least some of the other components of the naturally occurring organism or virus, for example, the cell or viral structural components or other polypeptides or nucleic acids commonly found associated with the nucleic acid or nucleotide sequence.

Likewise, an "isolated" polypeptide means a polypeptide that is separated or substantially free from at least some of the other components of the naturally occurring organism or virus, for example, the cell or viral structural components or other polypeptides or nucleic acids commonly found associated with the polypeptide.

By the term "treat," "treating," or "treatment of" (or grammatically equivalent terms) it is meant that the severity of the subject's condition is reduced or at least partially improved or ameliorated and/or that some alleviation, mitigation or decrease in at least one clinical symptom is achieved and/or there is a delay in the progression of the condition and/or prevention or delay of the onset of a disease or disorder.

As used herein, the term "prevent," "prevents," or "prevention" (and grammatical equivalents thereof) refers to a delay in the onset of a disease or disorder or the lessening of symptoms upon onset of the disease or disorder. The terms are not meant to imply complete abolition of disease and encompasses any type of prophylactic treatment that reduces the incidence of the condition or delays the onset and/or progression of the condition.

An "effective" or "therapeutically effective" amount as used herein is an amount that is sufficient to provide some improvement or benefit to the subject. Alternatively stated, an "effective" or "therapeutically effective" amount is an amount that will provide some alleviation, mitigation, or decrease in at least one clinical symptom in the subject. Those skilled in the art will appreciate that the therapeutic effects need not be complete or curative, as long as some benefit is provided to the subject.

A "heterologous nucleotide sequence" or "heterologous nucleic acid" is a sequence that is not naturally occurring in the virus. Generally, the heterologous nucleic acid or nucleotide sequence comprises an open reading frame that encodes a polypeptide and/or a nontranslated RNA.

A "therapeutic polypeptide" can be a polypeptide that can alleviate or reduce symptoms that result from an absence or defect in a protein in a cell or subject. In addition, a "therapeutic polypeptide" can be a polypeptide that otherwise confers a benefit to a subject, e.g., anti-cancer effects or improvement in transplant survivability.

As used herein, the term "vector," "virus vector," "delivery vector" (and similar terms) generally refers to a virus particle that functions as a nucleic acid delivery vehicle, and which comprises the viral nucleic acid (i.e., the vector genome) packaged within the virion. Virus vectors according to the present invention comprise a chimeric AAV capsid according to the invention and can package an AAV or rAAV genome or any other nucleic acid including viral nucleic acids. Alternatively, in some contexts, the term "vector," "virus vector," "delivery vector" (and similar terms) may be used to refer to the vector genome (e.g., vDNA) in the absence of the virion and/or to a viral capsid that acts as a transporter to deliver molecules tethered to the capsid or packaged within the capsid.

A "recombinant AAV vector genome" or "rAAV genome" is an AAV genome (i.e., vDNA) that comprises at least one inverted terminal repeat (e.g., one, two or three inverted terminal repeats) and one or more heterologous nucleotide sequences. rAAV vectors generally retain the 145 base terminal repeat(s) (TR(s)) in cis to generate virus; however, modified AAV TRs and non-AAV TRs including partially or completely synthetic sequences can also serve this purpose. All other viral sequences are dispensable and may be supplied in trans (Muzyczka, (1992) Curr. Topics Microbiol. Immunol. 158:97). The rAAV vector optionally comprises two TRs (e.g., AAV TRs), which generally will be at the 5' and 3' ends of the heterologous nucleotide sequence(s), but need not be contiguous thereto. The TRs can be the same or different from each other. The vector genome can also contain a single ITR at its 3' or 5' end.

The term "terminal repeat" or "TR" includes any viral terminal repeat or synthetic sequence that forms a hairpin structure and functions as an inverted terminal repeat (i.e., mediates the desired functions such as replication, virus packaging, integration and/or provirus rescue, and the like). The TR can be an AAV TR or a non-AAV TR. For example, a non-AAV TR sequence such as those of other parvoviruses (e.g., canine parvovirus (CPV), mouse parvovirus (MVM), human parvovirus B-19) or the SV40 hairpin that serves as the origin of SV40 replication can be used as a TR, which can further be modified by truncation, substitution, deletion, insertion and/or addition. Further, the TR can be partially or completely synthetic, such as the "double-D sequence" as described in U.S. Pat. No. 5,478,745 to Samulski et al.

An "AAV terminal repeat" or "AAV TR" may be from any AAV, including but not limited to serotypes 1, 2, 3, 4, 5, 6, 7, 8, 9, 10 or 11 or any other AAV now known or later discovered (see, e.g., Table 1). An AAV terminal repeat need not have the native terminal repeat sequence (e.g., a native AAV TR sequence may be altered by insertion, deletion, truncation and/or missense mutations), as long as the terminal repeat mediates the desired functions, e.g., replication, virus packaging, integration, and/or provirus rescue, and the like.

The terms "rAAV particle" and "rAAV virion" are used interchangeably here. A "rAAV particle" or "rAAV virion" comprises a rAAV vector genome packaged within an AAV capsid.

The AAV capsid structure is described in more detail in BERNARD N. FIELDS et al., VIROLOGY, volume 2, chapters 69 & 70 (4th ed., Lippincott-Raven Publishers).

By "substantially retain" a property, it is meant that at least about 75%, 85%, 90%, 95%, 97%, 98%, 99% or 100% of the property (e.g., activity or other measurable characteristic) is retained.

II. Chimeric AAV Capsids Targeted to the CNS

The inventors have identified chimeric AAV capsid structures capable of providing widespread CNS gene transfer with minimal tropism for peripheral organs. Thus, one aspect of the invention relates to chimeric AAV capsid structures capable of providing CNS gene transfer in a subject, e.g., a wild-type subject, e.g., a subject that does not have a CNS disorder. In certain embodiments, the invention relates to a nucleic acid encoding an AAV capsid, the nucleic acid comprising, consisting essentially of, or consisting of an AAV capsid coding sequence that is at least 70% identical to: (a) the nucleotide sequence of any one of SEQ ID NOS:1-43; or (b) a nucleotide sequence encoding any one of SEQ ID NOS:44-86; and viruses comprising the chimeric AAV capsids. In some embodiments, the AAV capsid coding sequence is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to the nucleotide sequence of (a) or (b). In another embodiment, the AAV capsid coding sequence comprises, consist essentially of, or consist of the nucleotide sequence of (a) or (b).

In certain embodiments, the invention relates to a nucleic acid encoding an AAV capsid, the nucleic acid comprising, consisting essentially of, or consisting of the VP1, VP2, or VP1/VP2 encoding portion of an AAV capsid coding sequence that is at least 70% identical to: (a) the nucleotide sequence of any one of SEQ ID NOS:1-43; or (b) a nucleotide sequence encoding any one of SEQ ID NOS:44-86; operably linked to the VP3 encoding portion of a different AAV capsid coding sequence; and viruses comprising the chimeric AAV capsids. In some embodiments, the VP1, VP2, or VP1/VP2 encoding portion of the AAV capsid coding sequence is at least 70%, 71%, 72%, 73%, 74%, 75%, 76%, 77%, 78%, 79%, 80%, 81%, 82%, 83%, $4%, 85%, 86%, 87%, 88%, 89%, 90%, 91%, 92%, 93%, 94%, 95%, 96%, 97%, 98% or 99% identical to the VP1, VP2, or VP1/VP2 encoding portion of the nucleotide sequence of (a) or (b). In another embodiment, the VP1, VP2, or VP1/VP2 encoding portion of the AAV capsid coding sequence comprises, consists essentially of, or consists of the VP1, VP2, or VP1/VP2 encoding portion of the nucleotide sequence of (a) or (b). In some embodiments, the VP3 encoding portion of a different AAV capsid coding sequence is a wild-type capsid sequence (e.g., AAV8 or AAV9) or a chimeric sequence that is different from any of the capsid sequences of the present invention.

Another aspect of the invention relates to chimeric AAV capsid structures capable of providing CNS gene transfer in a subject having a CNS disorder, e.g., a neurodevelopmental disorder, in particular Rett syndrome, e.g., a disorder caused by a mutation in the gene (MECP2) encoding methyl cytosine binding protein 2. In certain embodiments, the invention relates to a nucleic acid encoding an AAV capsid, the nucleic acid comprising, consisting essentially of, or consisting of an AAV capsid coding sequence that is at least 70% identical to: (a) the nucleotide sequence of any one of SEQ ID NOS: 87-107; or (b) a nucleotide sequence encoding any one of SEQ ID NOS: 108-128; and viruses comprising the chimeric AAV capsids. In some embodiments, the AAV capsid coding sequence is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to the nucleotide sequence of (a) or (b). In another embodiment, the AAV capsid coding sequence comprises, consist essentially of, or consist of the nucleotide sequence of (a) or (b).

In certain embodiments, the invention relates to a nucleic acid encoding an AAV capsid, the nucleic acid comprising, consisting essentially of, or consisting of the VP1, VP2, or VP1/VP2 encoding portion of an AAV capsid coding sequence that is at least 70% identical to: (a) the nucleotide sequence of any one of SEQ ID NOS: 87-107; or (b) a nucleotide sequence encoding any one of SEQ ID NOS: 108-128; operably linked to the VP3 encoding portion of a different AAV capsid coding sequence; and viruses comprising the chimeric AAV capsids. In some embodiments, the VP1, VP2, or VP1/VP2 encoding portion of the AAV capsid coding sequence is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to the VP1, VP2, or VP1/VP2 encoding portion of the nucleotide sequence of (a) or (b). In another embodiment, the VP1, VP2, or VP1/VP2 portion of the AAV capsid coding sequence comprises, consists essentially of, or consists of the VP1, VP2, or VP1/VP2 encoding portion of the nucleotide sequence of (a) or (b). In some embodiments, the VP3 encoding portion of a different AAV capsid coding sequence is a wild-type capsid sequence (e.g., AAV8 or AAV9) or a chimeric sequence that is different from any of the capsid sequences of the present invention.

SEQ ID NOS:44-86 and 108-128 show the VP1 capsid protein sequence. The designation of all amino acid positions in the description of the invention and the appended claims is with respect to VP1 numbering. Those skilled in the art will understand that the AAV capsid generally contains the smaller VP2 and VP3 capsid proteins as well. Due to the overlap of the coding sequences for the AAV capsid proteins, the nucleic acid coding sequences and amino acid sequences of the VP2 and VP3 capsid proteins will be apparent from the VP1 sequences shown in the disclosed sequences. In particular, VP2 starts at nucleotide 412 (acg) of SEQ ID NO:1 and threonine 138 of SEQ ID NO:44. VP3 starts at nucleotide 607 (atg) of SEQ ID NO:1 and methionine 203 of SEQ ID NO:44. In certain embodiments, isolated VP2 and VP3 capsid proteins comprising the sequence from SEQ ID NO:44 and isolated nucleic acids encoding the VP2 or VP3 proteins, or both, are contemplated.

The invention also provides chimeric AAV capsid proteins and chimeric capsids, wherein the capsid protein comprises, consists essentially of, or consists of an amino acid sequence as shown in SEQ ID NOS:44-86 and 108-128, wherein 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer of the amino acids within the capsid protein coding sequence of SEQ ID NOS:44-86 and 108-128 is substituted by another amino acid (naturally occurring, modified and/or synthetic), optionally a conservative amino acid substitution, and/or are deleted and/or there are insertions (including N-terminal and C-terminal extensions) of 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer amino acids or any combination of substitutions, deletions and/or insertions, wherein the substitutions, deletions and/or insertions do not unduly impair the structure and/or function of a virion (e.g., an AAV virion) comprising the variant capsid protein or capsid. For example, in representative embodiments of the invention, an AAV virion comprising the chimeric capsid protein substantially retains at least one property of a chimeric virion comprising a chimeric capsid protein as shown in SEQ ID NOS:44-86 and 108-128. For example, the virion comprising the chimeric capsid protein can substantially retain the CNS tropism profile of a virion comprising the chimeric AAV capsid protein as shown in SEQ ID NOS:44-86 and 108-128. Methods of evaluating biological properties such as virus transduction are well-known in the art (see, e.g., the Examples).

Conservative amino acid substitutions are known in the art. In particular embodiments, a conservative amino acid substitution includes substitutions within one or more of the following groups: glycine, alanine; valine, isoleucine, leucine; aspartic acid, glutamic acid; asparagine, glutamine; serine, threonine; lysine, arginine; and/or phenylalanine, tyrosine.

It will be apparent to those skilled in the art that the amino acid sequences of the chimeric AAV capsid protein of SEQ ID NOS:44-86 and 108-128 can further be modified to incorporate other modifications as known in the art to impart desired properties. As nonlimiting possibilities, the capsid protein can be modified to incorporate targeting sequences (e.g., RGD) or sequences that facilitate purification and/or detection. For example, the capsid protein can be fused to all or a portion of glutathione-S-transferase, maltose-binding protein, a heparin/heparan sulfate binding domain, poly-His, a ligand, and/or a reporter protein (e.g., Green Fluorescent Protein, β-glucuronidase, β-galactosidase, luciferase, etc.), an immunoglobulin Fc fragment, a single-chain antibody, hemagglutinin, c-myc, FLAG epitope, and the like to form a fusion protein. Methods of inserting targeting peptides into the AAV capsid are known in the art (see, e.g., international patent publication WO 00/28004; Nicklin et al., (2001) *Mol. Ther.* 474-181; White et al., (2004) *Circulation* 109:513-319; Muller et al., (2003) *Nature Biotech.* 21:1040-1046.

The viruses of the invention can further comprise a duplexed viral genome as described in international patent publication WO 01/92551 and U.S. Pat. No. 7,465,583.

The invention also provides AAV capsids comprising the chimeric AAV capsid proteins of the invention and virus particles (i.e., virions) comprising the same, wherein the virus particle packages (i.e., encapsidates) a vector genome, optionally an AAV vector genome. In particular embodiments, the invention provides an AAV particle comprising an AAV capsid comprising an AAV capsid protein of the invention, wherein the AAV capsid packages an AAV vector genome. The invention also provides an AAV particle comprising an AAV capsid or AAV capsid protein encoded by the chimeric nucleic acid capsid coding sequences of the invention.

In particular embodiments, the virion is a recombinant vector comprising a heterologous nucleic acid of interest, e.g., for delivery to a cell. Thus, the present invention is useful for the delivery of nucleic acids to cells in vitro, ex vivo, and in vivo. In representative embodiments, the recombinant vector of the invention can be advantageously employed to deliver or transfer nucleic acids to animal (e.g., mammalian) cells.

Any heterologous nucleotide sequence(s) may be delivered by a virus vector of the present invention. Nucleic acids of interest include nucleic acids encoding polypeptides, optionally therapeutic (e.g., for medical or veterinary uses) and/or immunogenic (e.g., for vaccines) polypeptides.

In some embodiments, the polypeptide is one that stimulates growth and/or differentiation of CNS cells, e.g., neurons, glial cells, oligodendrocytes, astrocytes, microglia, and/or ependymal cells. Examples include, without limitation, insulin-like growth factor-1, glial-derived neurotrophic factor, neurotrophin-3, neurotrophin-4, artemin, neurterin, persephin, brain-derived neurotrophic factor, nerve growth factor, ciliary neurotrophic factor, transforming growth factor alpha, platelet-derived growth factor, leukemia inhibitory factor, prolactin, monocarboxylate transporter 1, or nuclear factor 1A.

Therapeutic polypeptides include, but are not limited to, cystic fibrosis transmembrane regulator protein (CFTR), dystrophin (including the protein product of dystrophin mini-genes or micro-genes, see, e.g., Vincent et al., (1993) *Nature Genetics* 5:130; U.S. Patent Publication No. 2003017131; Wang et al., (2000) *Proc. Natl. Acad. Sci. USA* 97:13714-9 [mini-dystrophin]; Harper et al., (2002) *Nature Med.* 8:253-61 [micro-dystrophin]); mini-agrin, a laminin-α2, a sarcoglycan (α, β, γ or δ), Fukutin-related protein, myostatin pro-peptide, follistatin, dominant negative myostatin, an angiogenic factor (e.g., VEGF, angiopoietin-1 or 2), an anti-apoptotic factor (e.g., heme-oxygenase-1, TGF-β, inhibitors of pro-apoptotic signals such as caspases, proteases, kinases, death receptors [e.g., CD-095], modulators of cytochrome C release, inhibitors of mitochondrial pore opening and swelling); activin type II soluble receptor, anti-inflammatory polypeptides such as the Ikappa B dominant mutant, sarcospan, utrophin, mini-utrophin, antibodies or antibody fragments against myostatin or myostatin pro-peptide, cell cycle modulators, Rho kinase modulators such as Cethrin, which is a modified bacterial C3 exoenzyme [available from BioAxone Therapeutics, Inc., Saint-Lauren, Quebec, Canada], BCL-xL, BCL2, XIAP, FLICEc-s, dominant-negative caspase-8, dominant negative caspase-9, SPI-6 (see, e.g., U.S. Patent Application No. 20070026076), transcriptional factor PGC-α1, Pinch gene, ILK gene and thymosin β4 gene), clotting factors (e.g., Factor VIII, Factor IX, Factor X, etc.), erythropoietin, angiostatin, endostatin, catalase, tyrosine hydroxylase, an intracellular and/or extracellular superoxide dismutase, leptin, the LDL receptor, neprilysin, lipoprotein lipase, ornithine transcarbamylase, β-globin, α-globin, spectrin, $\alpha_1$-antitrypsin, methyl cytosine binding protein 2, adenosine deaminase, hypoxanthine guanine phosphoribosyl transferase, β-glucocerebrosidase, sphingomyelinase, lysosomal hexosaminidase A, branched-chain keto acid dehydrogenase, RP65 protein, a cytokine (e.g., α-interferon, β-interferon, interferon-γ, interleukins-1 through -14, granulocyte-macrophage colony stimulating factor, lymphotoxin, and the like), peptide growth factors, neurotrophic factors and hormones (e.g., somatotropin, insulin, insulin-like growth factors including IGF-1 and IGF-2, GLP-1, platelet derived growth factor, epidermal growth factor, fibroblast growth factor, nerve growth factor, neurotrophic factor-3 and -4, brain-derived neurotrophic factor, glial derived growth factor, transforming growth factor-α and -β, and the like), bone morphogenic proteins (including RANKL and VEGF), a lysosomal protein, a glutamate receptor, a lymphokine, soluble CD4, an Fc receptor, a T cell receptor, ApoE, ApoC, inhibitor 1 of protein phosphatase inhibitor 1 (I-1), phospholamban, serca2a, lysosomal acid α-glucosidase, α-galactosidase A, Barkct, β2-adrenergic receptor, β2-adrenergic receptor kinase (BARK), phosphoinositide-3 kinase (PI3 kinase), calsarcin, a receptor (e.g., the tumor necrosis growth factor-α soluble receptor), an anti-inflammatory factor such as IRAP, Pim-1, PGC-1α, SOD-1, SOD-2, ECF-SOD, kallikrein, thymosin-β4, hypoxia-inducible transcription factor [HIF], an angiogenic factor, S100A1, parvalbumin, adenylyl cyclase type 6, a molecule that effects G-protein coupled receptor kinase type 2 knockdown such as a truncated constitutively active bARKct; phospholamban inhibitory or dominant-negative molecules such as phospholamban S16E, a monoclonal antibody (including single chain monoclonal antibodies) or a suicide gene product (e.g., thymidine kinase, cytosine deaminase, diphtheria toxin, and tumor necrosis factors such as TNF-α), and any other polypeptide that has a therapeutic effect in a subject in need thereof.

Heterologous nucleotide sequences encoding polypeptides include those encoding reporter polypeptides (e.g., an enzyme). Reporter polypeptides are known in the art and include, but are not limited to, a fluorescent protein (e.g., EGFP, GFP, RFP, BFP, YFP, or dsRED2), an enzyme that produces a detectable product, such as luciferase (e.g., from *Gaussia, Renilla*, or *Photinus*), β-galactosidase, β-glucuronidase, alkaline phosphatase, and chloramphenicol acetyltransferase gene, or proteins that can be directly detected. Virtually any protein can be directly detected by using, for example, specific antibodies to the protein. Additional markers (and associated antibiotics) that are suitable for either positive or negative selection of eukaryotic cells are disclosed in Sambrook and Russell (2001), *Molecular Cloning*, 3rd Ed., Cold Spring Harbor Laboratory Press, Cold Spring Harbor, N.Y., and Ausubel et al. (1992), *Current Protocols in Molecular Biology*, John Wiley & Sons, including periodic updates.

Alternatively, the heterologous nucleic acid may encode a functional RNA, e.g., an antisense oligonucleotide, a ribozyme (e.g., as described in U.S. Pat. No. 5,877,022), RNAs that effect spliceosome-mediated trans-splicing (see, Puttaraju et al., (1999) *Nature Biotech*. 17:246; U.S. Pat. Nos. 6,013,487; 6,083,702), interfering RNAs (RNAi) including small interfering RNAs (siRNA) that mediate gene silencing (see, Sharp et al., (2000) *Science* 287:2431), microRNA, or other non-translated "functional" RNAs, such as "guide" RNAs (Gorman et al., (1998) *Proc. Nat. Acad. Sci. USA* 95:4929; U.S. Pat. No. 5,869,248 to Yuan et al.), and the like. Exemplary untranslated RNAs include RNAi or antisense RNA against the multiple drug resistance (MDR) gene product (e.g., to treat tumors and/or for administration to the heart to prevent damage by chemotherapy), RNAi or antisense RNA against myostatin (Duchenne or Becker muscular dystrophy), RNAi or antisense RNA against VEGF or a tumor immunogen including but not limited to those tumor immunogens specifically described herein (to treat tumors), RNAi or antisense oligonucleotides targeting mutated dystrophins (Duchenne or Becker muscular dystrophy), RNAi or antisense RNA against the hepatitis B surface antigen gene (to prevent and/or treat hepatitis B infection), RNAi or antisense RNA against the HIV tat and/or rev genes (to prevent and/or treat HIV) and/or RNAi or antisense RNA against any other immunogen from a pathogen (to protect a subject from the pathogen) or a defective gene product (to prevent or treat disease). RNAi or antisense RNA against the targets described above or any other target can also be employed as a research reagent.

As is known in the art, anti-sense nucleic acids (e.g., DNA or RNA) and inhibitory RNA (e.g., microRNA and RNAi such as siRNA or shRNA) sequences can be used to induce "exon skipping" in patients with muscular dystrophy arising from defects in the dystrophin gene. Thus, the heterologous nucleic acid can encode an antisense nucleic acid or inhibitory RNA that induces appropriate exon skipping. Those skilled in the art will appreciate that the particular approach to exon skipping depends upon the nature of the underlying defect in the dystrophin gene, and numerous such strategies are known in the art. Exemplary antisense nucleic acids and inhibitory RNA sequences target the upstream branch point and/or downstream donor splice site and/or internal splicing enhancer sequence of one or more of the dystrophin exons (e.g., exons 19 or 23). For example, in particular embodiments, the heterologous nucleic acid encodes an antisense nucleic acid or inhibitory RNA directed against the upstream branch point and downstream splice donor site of exon 19 or 23 of the dystrophin gene. Such sequences can be incorporated into an AAV vector delivering a modified U7 snRNA and the antisense nucleic acid or inhibitory RNA (see, e.g., Goyenvalle et al., (2004) *Science* 306:1796-1799). As another strategy, a modified U1 snRNA can be incorporated into an AAV vector along with siRNA, microRNA or antisense RNA complementary to the upstream and downstream splice sites of a dystrophin exon (e.g., exon 19 or 23) (see, e.g., Denti et al., (2006) *Proc. Nat. Acad. Sci. USA* 103:3758-3763). Further, antisense nucleic acids and inhibitory RNA can target the splicing enhancer sequences within exons 19, 43, 45 or 53 (see, e.g., U.S. Pat. Nos. 6,653,467; 6,727,355; and 6,653,466).

Ribozymes are RNA-protein complexes that cleave nucleic acids in a site-specific fashion. Ribozymes have specific catalytic domains that possess endonuclease activity (Kim et al., (1987) *Proc. Natl. Acad. Sci. USA* 84:8788; Gerlach et al., (1987) *Nature* 328:802; Forster and Symons, (1987) *Cell* 49:211). For example, a large number of ribozymes accelerate phosphoester transfer reactions with a high degree of specificity, often cleaving only one of several phosphoesters in an oligonucleotide substrate (Michel and Westhof, (1990) *J. Mol. Biol*. 216:585; Reinhold-Hurek and Shub, (1992) *Nature* 357:173). This specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, (1989) *Nature* 338:217). For example, U.S. Pat. No. 5,354,855 reports that certain ribozymes can act as endonucleases with a sequence specificity greater than that of known ribonucleases and approaching that of the DNA restriction enzymes. Thus, sequence-specific ribozyme-mediated inhibition of nucleic acid expression may be particularly suited to therapeutic applications (Scanlon et al., (1991) *Proc. Natl. Acad Sci. USA* 88:10591; Sarver et al., (1990) *Science* 247:1222; Sioud et al., (1992) *J. Mol. Biol*. 223:831).

MicroRNAs (mir) are natural cellular RNA molecules that can regulate the expression of multiple genes by controlling the stability of the mRNA. Over-expression or diminution of a particular microRNA can be used to treat a dysfunction and has been shown to be effective in a number of disease states and animal models of disease (see, e.g., Couzin, (2008) *Science* 319:1782-4). The chimeric AAV can be used to deliver microRNA into cells, tissues and subjects for the treatment of genetic and acquired diseases, or to enhance functionality and promote growth of certain tissues. For example, mir-1, mir-133, mir-206 and/or mir-208 can be used to treat cardiac and skeletal muscle disease (see, e.g., Chen et al., (2006) *Genet*. 38:228-33; van Rooij et al., (2008) *Trends Genet*. 24:159-66). MicroRNA can also be used to modulate the immune system after gene delivery (Brown et al., (2007) *Blood* 110:4144-52).

The term "antisense oligonucleotide" (including "antisense RNA") as used herein, refers to a nucleic acid that is complementary to and specifically hybridizes to a specified DNA or RNA sequence. Antisense oligonucleotides and nucleic acids that encode the same can be made in accordance with conventional techniques. See, e.g., U.S. Pat. No. 5,023,243 to Tullis; U.S. Pat. No. 5,149,797 to Pederson et al.

Those skilled in the art will appreciate that it is not necessary that the antisense oligonucleotide be fully complementary to the target sequence as long as the degree of sequence similarity is sufficient for the antisense nucleotide sequence to specifically hybridize to its target (as defined above) and reduce production of the protein product (e.g., by at least about 30%, 40%, 50%, 60%, 70%, 80%, 90%, 95% or more).

To determine the specificity of hybridization, hybridization of such oligonucleotides to target sequences can be carried out under conditions of reduced stringency, medium stringency or even stringent conditions. Suitable conditions for achieving reduced, medium and stringent hybridization conditions are as described herein.

Alternatively stated, in particular embodiments, antisense oligonucleotides of the invention have at least about 60%, 70%, 80%, 90%, 95%, 97%, 98% or higher sequence identity with the complement of the target sequence and reduce production of the protein product (as defined above). In some embodiments, the antisense sequence contains 1, 2, 3, 4, 5, 6, 7, 8, 9 or 10 mismatches as compared with the target sequence.

Methods of determining percent identity of nucleic acid sequences are described in more detail elsewhere herein.

The length of the antisense oligonucleotide is not critical as long as it specifically hybridizes to the intended target and reduces production of the protein product (as defined above) and can be determined in accordance with routine procedures. In general, the antisense oligonucleotide is at least about eight, ten or twelve or fifteen nucleotides in length and/or less than about 20, 30, 40, 50, 60, 70, 80, 100 or 150 nucleotides in length.

RNA interference (RNAi) is another useful approach for reducing production of a protein product (e.g., shRNA or siRNA). RNAi is a mechanism of post-transcriptional gene silencing in which double-stranded RNA (dsRNA) corresponding to a target sequence of interest is introduced into a cell or an organism, resulting in degradation of the corresponding mRNA. The mechanism by which RNAi achieves gene silencing has been reviewed in Sharp et al., (2001) *Genes Dev* 15: 485-490; and Hammond et al., (2001) *Nature Rev. Gen.* 2:110-119). The RNAi effect persists for multiple cell divisions before gene expression is regained. RNAi is therefore a powerful method for making targeted knockouts or "knockdowns" at the RNA level. RNAi has proven successful in human cells, including human embryonic kidney and HeLa cells (see, e.g., Elbashir et al., *Nature* (2001) 411:494-8).

Initial attempts to use RNAi in mammalian cells resulted in antiviral defense mechanisms involving PKR in response to the dsRNA molecules (see, e.g., Gil et al., (2000) *Apoptosis* 5:107). It has since been demonstrated that short synthetic dsRNA of about 21 nucleotides, known as "short interfering RNAs" (siRNA) can mediate silencing in mammalian cells without triggering the antiviral response (see, e.g., Elbashir et al., *Nature* (2001) 411:494-8; Caplen et al., (2001) *Proc. Nat. Acad. Sci. USA* 98:9742).

The RNAi molecule (including an siRNA molecule) can be a short hairpin RNA (shRNA; see Paddison et al., (2002), *Proc. Nat. Acad. Sci. USA* 99:1443-1448), which is believed to be processed in the cell by the action of the RNase III like enzyme Dicer into 20-25 mer siRNA molecules. The shRNAs generally have a stem-loop structure in which two inverted repeat sequences are separated by a short spacer sequence that loops out. There have been reports of shRNAs with loops ranging from 3 to 23 nucleotides in length. The loop sequence is generally not critical. Exemplary loop sequences include the following motifs: AUG, CCC, UUCG, CCACC, CTCGAG, AAGCUU, CCACACC and UUCAAGAGA.

The RNAi can further comprise a circular molecule comprising sense and antisense regions with two loop regions on either side to form a "dumbbell" shaped structure upon dsRNA formation between the sense and antisense regions. This molecule can be processed in vitro or in vivo to release the dsRNA portion, e.g., a siRNA.

International patent publication WO 01/77350 describes a vector for bi-directional transcription to generate both sense and antisense transcripts of a heterologous sequence in a eukaryotic cell. This technique can be employed to produce RNAi for use according to the invention.

Shinagawa et al., (2003) *Genes Dev.* 17:1340 reported a method of expressing long dsRNAs from a CMV promoter (a pol II promoter), which method is also applicable to tissue specific pol II promoters. Likewise, the approach of Xia et al., (2002) *Nature Biotech.* 20:1006, avoids poly(A) tailing and can be used in connection with tissue-specific promoters.

Methods of generating RNAi include chemical synthesis, in vitro transcription, digestion of long dsRNA by Dicer (in vitro or in vivo), expression in vivo from a delivery vector, and expression in vivo from a PCR-derived RNAi expression cassette (see, e.g., TechNotes 10(3) "Five Ways to Produce siRNAs," from Ambion, Inc., Austin Tex.; available at www.ambion.com).

Guidelines for designing siRNA molecules are available (see e.g., literature from Ambion, Inc., Austin Tex.; available at www.ambion.com). In particular embodiments, the siRNA sequence has about 30-50% G/C content. Further, long stretches of greater than four T or A residues are generally avoided if RNA polymerase III is used to transcribe the RNA. Online siRNA target finders are available, e.g., from Ambion, Inc. (www.ambion.com), through the Whitehead Institute of Biomedical Research (www.jura.wi.mit.edu) or from Dharmacon Research, Inc. (www.dharmacon.com).

The antisense region of the RNAi molecule can be completely complementary to the target sequence, but need not be as long as it specifically hybridizes to the target sequence (as defined above) and reduces production of the protein product (e.g., by at least about 30%, 40%, 50%, 60%, 70%, 80%, 90%, 95% or more). In some embodiments, hybridization of such oligonucleotides to target sequences can be carried out under conditions of reduced stringency, medium stringency or even stringent conditions, as defined above.

In other embodiments, the antisense region of the RNAi has at least about 60%, 70%, 80%, 90%, 95%, 97%, 98% or higher sequence identity with the complement of the target sequence and reduces production of the protein product (e.g., by at least about 30%, 40%, 50%, 60%, 70%, 80%, 90%, 95% or more). In some embodiments, the antisense region contains 1, 2, 3, 4, 5, 6, 7, 8, 9 or 10 mismatches as compared with the target sequence. Mismatches are generally tolerated better at the ends of the dsRNA than in the center portion.

In particular embodiments, the RNAi is formed by intermolecular complexing between two separate sense and antisense molecules. The RNAi comprises a ds region formed by the intermolecular basepairing between the two separate strands. In other embodiments, the RNAi comprises a ds region formed by intramolecular basepairing within a single nucleic acid molecule comprising both sense and antisense regions, typically as an inverted repeat (e.g., a shRNA or other stem loop structure, or a circular RNAi molecule). The RNAi can further comprise a spacer region between the sense and antisense regions.

Generally, RNAi molecules are highly selective. If desired, those skilled in the art can readily eliminate candidate RNAi that are likely to interfere with expression of nucleic acids other than the target by searching relevant databases to identify RNAi sequences that do not have substantial sequence homology with other known sequences, for example, using BLAST (available at www.ncbi.nlm.nih.gov/BLAST).

Kits for the production of RNAi are commercially available, e.g., from New England Biolabs, Inc. and Ambion, Inc.

The recombinant virus vector may also comprise a heterologous nucleotide sequence that shares homology with and recombines with a locus on the host chromosome. This approach may be utilized to correct a genetic defect in the host cell.

The present invention also provides recombinant virus vectors that express an immunogenic polypeptide, e.g., for vaccination. The heterologous nucleic acid may encode any immunogen of interest known in the art including, but are not limited to, immunogens from human immunodeficiency virus, influenza virus, gag proteins, tumor antigens, cancer antigens, bacterial antigens, viral antigens, and the like. Alternatively, the immunogen can be presented in the virus capsid (e.g., incorporated therein) or tethered to the virus capsid (e.g., by covalent modification).

The use of parvoviruses as vaccines is known in the art (see, e.g., Miyamura et al., (1994) Proc. Nat. Acad. Sci. USA 91:8507; U.S. Pat. No. 5,916,563 to Young et al, U.S. Pat. No. 5,905,040 to Mazzara et al., U.S. Pat. Nos. 5,882,652, 5,863,541 to Samulski et al.; the disclosures of which are incorporated herein in their entireties by reference). The antigen may be presented in the virus capsid. Alternatively, the antigen may be expressed from a heterologous nucleic acid introduced into a recombinant vector genome.

An immunogenic polypeptide, or immunogen, may be any polypeptide suitable for protecting the subject against a disease, including but not limited to microbial, bacterial, protozoal, parasitic, fungal and viral diseases. For example, the immunogen may be an orthomyxovirus immunogen (e.g., an influenza virus immunogen, such as the influenza virus hemagglutinin (HA) surface protein or the influenza virus nucleoprotein gene, or an equine influenza virus immunogen), or a lentivirus immunogen (e.g., an equine infectious anemia virus immunogen, a Simian Immunodeficiency Virus (SIV) immunogen, or a Human Immunodeficiency Virus (HIV) immunogen, such as the HIV or SIV envelope GP160 protein, the HIV or SIV matrix/capsid proteins, and the HIV or SIV gag, pol and env genes products). The immunogen may also be an arenavirus immunogen (e.g., Lassa fever virus immunogen, such as the Lassa fever virus nucleocapsid protein gene and the Lassa fever envelope glycoprotein gene), a poxvirus immunogen (e.g., vaccinia, such as the vaccinia L1 or L8 genes), a flavivirus immunogen (e.g., a yellow fever virus immunogen or a Japanese encephalitis virus immunogen), a filovirus immunogen (e.g., an Ebola virus immunogen, or a Marburg virus immunogen, such as NP and OP genes), a bunyavirus immunogen (e.g., RVFV, CCHF, and SFS viruses), or a coronavirus immunogen (e.g., an infectious human coronavirus immunogen, such as the human coronavirus envelope glycoprotein gene, or a porcine transmissible gastroenteritis virus immunogen, or an avian infectious bronchitis virus immunogen, or a severe acute respiratory syndrome (SARS) immunogen such as a S [S1 or S2], M, E, or N protein or an immunogenic fragment thereof). The immunogen may further be a polio immunogen, herpes immunogen (e.g., CMV, EBV, HSV immunogens) mumps immunogen, measles immunogen, rubella immunogen, diphtheria toxin or other diphtheria immunogen, pertussis antigen, hepatitis (e.g., hepatitis A, hepatitis B or hepatitis C) immunogen, or any other vaccine immunogen known in the art.

Alternatively, the immunogen may be any tumor or cancer cell antigen. Optionally, the tumor or cancer antigen is expressed on the surface of the cancer cell. Exemplary cancer and tumor cell antigens are described in S. A. Rosenberg, (1999) *Immunity* 10:281). Illustrative cancer and tumor antigens include, but are not limited to: BRCA1 gene product, BRCA2 gene product, gp100, tyrosinase, GAGE-1/2, BAGE, RAGE, NY-ESO-1, CDK-4, β-catenin, MUM-1, Caspase-8, KIAA0205, HPVE, SART-1, PRAME, p15, melanoma tumor antigens (Kawakami et al., (1994) *Proc. Natl. Acad. Sci. USA* 91:3515; Kawakami et al., (1994) *J. Exp. Med.*, 180:347; Kawakami et al., (1994) *Cancer Res.* 54:3124) including MART-1 (Coulie et al., (1991) *J. Exp. Med.* 180:35), gp100 (Wick et al., (1988) *J. Cutan. Pathol.* 4:201) and MAGE antigen (MAGE-1, MAGE-2 and MAGE-3) (Van der Bruggen et al., (1991) *Science*, 254: 1643), CEA, TRP-1; TRP-2; P-15 and tyrosinase (Brichard et al., (1993) *J. Exp. Med.* 178:489); HER-2/neu gene product (U.S. Pat. No. 4,968,603); CA 125; HE4; LK26; FB5 (endosialin); TAG 72; AFP; CA19-9; NSE; DU-PAN-2; CA50; Span-1; CA72-4; HCG; STN (sialyl Tn antigen); c-erbB-2 proteins; PSA; L-CanAg; estrogen receptor; milk fat globulin; p53 tumor suppressor protein (Levine, (1993) *Ann. Rev. Biochem.* 62:623); mucin antigens (international patent publication WO 90/05142); telomerases; nuclear matrix proteins; prostatic acid phosphatase; papilloma virus antigens; and antigens associated with the following cancers: melanomas, adenocarcinoma, thymoma, sarcoma, lung cancer, liver cancer, colorectal cancer, non-Hodgkin's lymphoma, Hodgkin's lymphoma, leukemias, uterine cancer, breast cancer, prostate cancer, ovarian cancer, cervical cancer, bladder cancer, kidney cancer, pancreatic cancer, brain cancer, kidney cancer, stomach cancer, esophageal cancer, head and neck cancer and others (see, e.g., Rosenberg, (1996) *Annu. Rev. Med.* 47:481-91).

Alternatively, the heterologous nucleotide sequence may encode any polypeptide that is desirably produced in a cell in vitro, ex vivo, or in vivo. For example, the virus vectors may be introduced into cultured cells and the expressed protein product isolated therefrom.

It will be understood by those skilled in the art that the heterologous nucleic acid(s) of interest may be operably associated with appropriate control sequences. For example, the heterologous nucleic acid may be operably associated with expression control elements, such as transcription/translation control signals, origins of replication, polyadenylation signals, internal ribosome entry sites (IRES), promoters, enhancers, and the like.

Those skilled in the art will further appreciate that a variety of promoter/enhancer elements may be used depending on the level and tissue-specific expression desired. The promoter/enhancer may be constitutive or inducible, depending on the pattern of expression desired. The promoter/enhancer may be native or foreign and can be a natural or a synthetic sequence. By foreign, it is intended that the transcriptional initiation region is not found in the wild-type host into which the transcriptional initiation region is introduced.

Promoter/enhancer elements can be native to the target cell or subject to be treated and/or native to the heterologous nucleic acid sequence. The promoter/enhancer element is generally chosen so that it will function in the target cell(s) of interest. In representative embodiments, the promoter/enhancer element is a mammalian promoter/enhancer element. The promoter/enhance element may be constitutive or inducible.

Inducible expression control elements are generally used in those applications in which it is desirable to provide regulation over expression of the heterologous nucleic acid sequence(s). Inducible promoters/enhancer elements for gene delivery can be tissue-specific or tissue-preferred promoter/enhancer elements, and include muscle specific or preferred (including cardiac, skeletal and/or smooth muscle), neural tissue specific or preferred (including brain-specific), eye (including retina-specific and cornea-specific), liver specific or preferred, bone marrow specific or preferred, pancreatic specific or preferred, spleen specific or preferred, and lung specific or preferred promoter/enhancer elements. In one embodiment, a CNS cell-specific or CNS cell-preferred promoter is used. Examples of neuron-specific or preferred promoters include, without limitation, neuronal-specific enolase, synapsin, and MeCP2. Examples of astrocyte-specific or preferred promoters include, without limitation, glial fibrillary acidic protein and S100β. Examples of ependymal cell-specific or preferred promoters include, without limitation, wdr16, Foxj1, and LRP2. Examples of microglia-specific or preferred promoters include, without limitation, F4/80, CX3CR1, and CD11b. Examples of oligodendrocyte-specific or preferred promoters include, without limitation, myelin basic protein, cyclic nucleotide phosphodiesterase, proteolipid protein, Gtx, and Sox10. Use of a CNS cell-specific or preferred promoter can increase the specificity achieved by the chimeric AAV vector by further limiting expression of the heterologous nucleic acid to the CNS. Other inducible promoter/enhancer elements include hormone-inducible and metal-inducible elements. Exemplary inducible promoters/enhancer elements include, but are not limited to, a Tet on/off element, a RU486-inducible promoter, an ecdysone-inducible promoter, a rapamycin-inducible promoter, and a metallothionein promoter.

In embodiments wherein the heterologous nucleic acid sequence(s) is transcribed and then translated in the target cells, specific initiation signals are generally employed for efficient translation of inserted protein coding sequences. These exogenous translational control sequences, which may include the ATG initiation codon and adjacent sequences, can be of a variety of origins, both natural and synthetic.

The invention also provides chimeric AAV particles comprising an AAV capsid and an AAV genome, wherein the AAV genome "corresponds to" (i.e., encodes) the AAV capsid. Also provided are collections or libraries of such chimeric AAV particles, wherein the collection or library comprises 2 or more, 10 or more, 50 or more, 100 or more, 1000 or more, $10^4$ or more, $10^5$ or more, or $10^6$ or more distinct sequences.

The present invention further encompasses "empty" capsid particles (i.e., in the absence of a vector genome) comprising, consisting of, or consisting essentially of the chimeric AAV capsid proteins of the invention. The chimeric AAV capsids of the invention can be used as "capsid vehicles," as has been described in U.S. Pat. No. 5,863,541, Molecules that can be covalently linked, bound to or packaged by the virus capsids and transferred into a cell include DNA, RNA, a lipid, a carbohydrate, a polypeptide, a small organic molecule, or combinations of the same. Further, molecules can be associated with (e.g., "tethered to") the outside of the virus capsid for transfer of the molecules into host target cells. In one embodiment of the invention the molecule is covalently linked (i.e., conjugated or chemically coupled) to the capsid proteins. Methods of covalently linking molecules are known by those skilled in the art.

The virus capsids of the invention also find use in raising antibodies against the novel capsid structures. As a further alternative, an exogenous amino acid sequence may be inserted into the virus capsid for antigen presentation to a cell, e.g., for administration to a subject to produce an immune response to the exogenous amino acid sequence.

The invention also provides nucleic acids (e.g., isolated nucleic acids) encoding the chimeric virus capsids and chimeric capsid proteins of the invention. Further provided are vectors comprising the nucleic acids, and cells (in vivo or in culture) comprising the nucleic acids and/or vectors of the invention. Such nucleic acids, vectors and cells can be used, for example, as reagents (e.g., helper constructs or packaging cells) for the production of virus vectors as described herein.

In exemplary embodiments, the invention provides nucleic acid sequences encoding the AAV capsid of SEQ ID NOS: 44-86 or 108-128 or at least 70% identical to the nucleotide sequence of SEQ ID NOS: 1-44 or 87-107. The invention also provides nucleic acids encoding the AAV capsid variants, capsid protein variants and fusion proteins as described above. In particular embodiments, the nucleic acid hybridizes to the complement of the nucleic acid sequences specifically disclosed herein under standard conditions as known by those skilled in the art and encodes a variant capsid and/or capsid protein. Optionally, the variant capsid or capsid protein substantially retains at least one property of the capsid and/or capsid or capsid protein encoded by the nucleic acid sequence of SEQ ID NOS: 1-44 or 87-107. For example, a virus particle comprising the variant capsid or variant capsid protein can substantially retain the CNS tropism profile of a virus particle comprising a capsid or capsid protein encoded by a nucleic acid coding sequence of SEQ ID NO:1-44 or 87-107.

For example, hybridization of such sequences may be carried out under conditions of reduced stringency, medium stringency or even stringent conditions. Exemplary conditions for reduced, medium and stringent hybridization are as follows: (e.g., conditions represented by a wash stringency of 35-40% Formamide with 5×Denhardt's solution, 0.5% SDS and 1×SSPE at 37° C.; conditions represented by a wash stringency of 40-45% Formamide with 5×Denhardt's solution, 0.5% SDS, and 1×SSPE at 42° C.; and conditions represented by a wash stringency of 50% Formamide with 5×Denhardt's solution, 0.5% SDS and 1×SSPE at 42° C., respectively). See, e.g., Sambrook et al., *Molecular Cloning, A Laboratory Manual* (2d Ed. 1989) (Cold Spring Harbor Laboratory).

In other embodiments, nucleic acid sequences encoding a variant capsid or capsid protein of the invention have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, or higher sequence identity with the nucleic acid sequence of SEQ ID NO:1-44 or 87-107 and optionally encode a variant capsid or capsid protein that substantially retains at least one property of the capsid or capsid protein encoded by a nucleic acid of SEQ ID NO:1-44 or 87-107.

As is known in the art, a number of different programs can be used to identify whether a nucleic acid or polypeptide has sequence identity to a known sequence. Percent identity as used herein means that a nucleic acid or fragment thereof shares a specified percent identity to another nucleic acid, when optimally aligned (with appropriate nucleotide insertions or deletions) with the other nucleic acid (or its complementary strand), using BLASTN. To determine percent identity between two different nucleic acids, the percent identity is to be determined using the BLASTN program "BLAST 2 sequences". This program is available for public use from the National Center for Biotechnology Information (NCBI) over the Internet (Altschul et al., (1997) *Nucleic Acids Res.* 25(17):3389-3402). The parameters to be used are whatever combination of the following yields the highest calculated percent identity (as calculated below) with the default parameters shown in parentheses: Program—blastn Matrix—0 BLOSUM62 Reward for a match—0 or 1 (1) Penalty for a mismatch—0, -1, -2 or -3 (-2) Open gap penalty—0, 1, 2, 3, 4 or 5 (5) Extension gap penalty—0 or 1 (1) Gap x_dropoff—0 or 50 (50) Expect—10.

Percent identity or similarity when referring to polypeptides, indicates that the polypeptide in question exhibits a specified percent identity or similarity when compared with another protein or a portion thereof over the common lengths as determined using BLASTP. This program is also available for public use from the National Center for Biotechnology Information (NCBI) over the Internet (Altschul et al., (1997) *Nucleic Acids Res.* 25(17):3389-3402). Percent identity or similarity for polypeptides is typically measured using sequence analysis software. See, e.g., the Sequence Analysis Software Package of the Genetics Computer Group, University of Wisconsin Biotechnology Center, 910 University Avenue, Madison, Wis. 53705. Protein analysis software matches similar sequences using measures of homology assigned to various substitutions, deletions and other modifications. Conservative substitutions typically include substitutions within the following groups: glycine, alanine; valine, isoleucine, leucine; aspartic acid, glutamic acid; asparagine, glutamine; serine, threonine; lysine, arginine; and phenylalanine, tyrosine.

In particular embodiments, the nucleic acid can comprise, consist essentially of, or consist of a vector including but not limited to a plasmid, phage, viral vector (e.g., AAV vector, an adenovirus vector, a herpesvirus vector, or a baculovirus vector), bacterial artificial chromosome (BAC), or yeast artificial chromosome (YAC). For example, the nucleic acid can comprise, consist of, or consist essentially of an AAV vector comprising a 5' and/or 3' terminal repeat (e.g., 5' and/or 3' AAV terminal repeat).

In some embodiments, the nucleic acid encoding the chimeric AAV capsid protein further comprises an AAV rep coding sequence. For example, the nucleic acid can be a helper construct for producing viral stocks.

The invention also provides packaging cells stably comprising a nucleic acid of the invention. For example, the nucleic acid can be stably incorporated into the genome of the cell or can be stably maintained in an episomal form (e.g., an "EBV based nuclear episome").

The nucleic acid can be incorporated into a delivery vector, such as a viral delivery vector. To illustrate, the nucleic acid of the invention can be packaged in an AAV particle, an adenovirus particle, a herpesvirus particle, a baculovirus particle, or any other suitable virus particle.

Moreover, the nucleic acid can be operably associated with a promoter element. Promoter elements are described in more detail herein.

The present invention further provides methods of producing the virus vectors of the invention. In a representative embodiment, the present invention provides a method of producing a recombinant virus vector, the method comprising providing to a cell in vitro, (a) a template comprising (i) a heterologous nucleic acid, and (ii) packaging signal sequences sufficient for the encapsidation of the AAV template into virus particles (e.g., one or more (e.g., two) terminal repeats, such as AAV terminal repeats), and (b) AAV sequences sufficient for replication and encapsidation of the template into viral particles (e.g., the AAV rep and AAV cap sequences encoding an AAV capsid of the invention). The template and AAV replication and capsid sequences are provided under conditions such that recombinant virus particles comprising the template packaged within the capsid are produced in the cell. The method can further comprise the step of collecting the virus particles from the cell. Virus particles may be collected from the medium and/or by lysing the cells.

In one illustrative embodiment, the invention provides a method of producing a rAAV particle comprising an AAV capsid, the method comprising: providing a cell in vitro with a nucleic acid encoding a chimeric AAV capsid of the invention, an AAV rep coding sequence, an AAV vector genome comprising a heterologous nucleic acid, and helper functions for generating a productive AAV infection; and allowing assembly of the AAV particles comprising the AAV capsid and encapsidating the AAV vector genome.

The cell is typically a cell that is permissive for AAV viral replication. Any suitable cell known in the art may be employed, such as mammalian cells. Also suitable are trans-complementing packaging cell lines that provide functions deleted from a replication-defective helper virus, e.g., 293 cells or other E1a trans-complementing cells.

The AAV replication and capsid sequences may be provided by any method known in the art. Current protocols typically express the AAV rep/cap genes on a single plasmid. The AAV replication and packaging sequences need not be provided together, although it may be convenient to do so. The AAV rep and/or cap sequences may be provided by any viral or non-viral vector. For example, the rep/cap sequences may be provided by a hybrid adenovirus or herpesvirus vector (e.g., inserted into the E1a or E3 regions of a deleted adenovirus vector). EBV vectors may also be employed to express the AAV cap and rep genes. One advantage of this method is that EBV vectors are episomal, yet will maintain a high copy number throughout successive cell divisions (i.e., are stably integrated into the cell as extra-chromosomal elements, designated as an EBV based nuclear episome.

As a further alternative, the rep/cap sequences may be stably carried (episomal or integrated) within a cell.

Typically, the AAV rep/cap sequences will not be flanked by the AAV packaging sequences (e.g., AAV ITRs), to prevent rescue and/or packaging of these sequences.

The template (e.g., an rAAV vector genome) can be provided to the cell using any method known in the art. For example, the template may be supplied by a non-viral (e.g., plasmid) or viral vector. In particular embodiments, the template is supplied by a herpesvirus or adenovirus vector (e.g., inserted into the E1a or E3 regions of a deleted adenovirus). As another illustration, Palombo et al., (1998) *J. Virol.* 72:5025, describe a baculovirus vector carrying a reporter gene flanked by the AAV ITRs. EBV vectors may also be employed to deliver the template, as described above with respect to the rep/cap genes.

In another representative embodiment, the template is provided by a replicating rAAV virus. In still other embodiments, an AAV provirus is stably integrated into the chromosome of the cell.

To obtain maximal virus titers, helper virus functions (e.g., adenovirus or herpesvirus) essential for a productive AAV infection are generally provided to the cell. Helper virus sequences necessary for AAV replication are known in the art. Typically, these sequences are provided by a helper adenovirus or herpesvirus vector. Alternatively, the adenovirus or herpesvirus sequences can be provided by another non-viral or viral vector, e.g., as a non-infectious adenovirus miniplasmid that carries all of the helper genes required for efficient AAV production as described by Ferrari et al., (1997) *Nature Med.* 3:1295, and U.S. Pat. Nos. 6,040,183 and 6,093,570.

Further, the helper virus functions may be provided by a packaging cell with the helper genes integrated in the chromosome or maintained as a stable extrachromosomal element. In representative embodiments, the helper virus sequences cannot be packaged into AAV virions, e.g., are not flanked by AAV ITRs.

Those skilled in the art will appreciate that it may be advantageous to provide the AAV replication and capsid sequences and the helper virus sequences (e.g., adenovirus sequences) on a single helper construct. This helper construct may be a non-viral or viral construct, but is optionally a hybrid adenovirus or hybrid herpesvirus comprising the AAV rep/cap genes.

In one particular embodiment, the AAV rep/cap sequences and the adenovirus helper sequences are supplied by a single adenovirus helper vector. This vector further contains the rAAV template. The AAV rep/cap sequences and/or the rAAV template may be inserted into a deleted region (e.g., the E1a or E3 regions) of the adenovirus.

In a further embodiment, the AAV rep/cap sequences and the adenovirus helper sequences are supplied by a single adenovirus helper vector. The rAAV template is provided as a plasmid template.

In another illustrative embodiment, the AAV rep/cap sequences and adenovirus helper sequences are provided by a single adenovirus helper vector, and the rAAV template is integrated into the cell as a provirus. Alternatively, the rAAV template is provided by an EBV vector that is maintained within the cell as an extrachromosomal element (e.g., as a "EBV based nuclear episome," see Margolski, (1992) *Curr. Top. Microbiol. Immun.* 158:67).

In a further exemplary embodiment, the AAV rep/cap sequences and adenovirus helper sequences are provided by a single adenovirus helper. The rAAV template is provided as a separate replicating viral vector. For example, the rAAV template may be provided by a rAAV particle or a second recombinant adenovirus particle.

According to the foregoing methods, the hybrid adenovirus vector typically comprises the adenovirus 5' and 3' cis sequences sufficient for adenovirus replication and packaging (i.e., the adenovirus terminal repeats and PAC sequence). The AAV rep/cap sequences and, if present, the rAAV template are embedded in the adenovirus backbone and are flanked by the 5' and 3' cis sequences, so that these sequences may be packaged into adenovirus capsids. As described above, in representative embodiments, the adenovirus helper sequences and the AAV rep/cap sequences are not flanked by the AAV packaging sequences (e.g., the AAV ITRs), so that these sequences are not packaged into the AAV virions.

Herpesvirus may also be used as a helper virus in AAV packaging methods. Hybrid herpesviruses encoding the AAV rep protein(s) may advantageously facilitate for more scalable AAV vector production schemes. A hybrid herpes simplex virus type I (HSV-1) vector expressing the AAV-2 rep and cap genes has been described (Conway et al., (1999) *Gene Therapy* 6:986 and WO 00/17377, the disclosures of which are incorporated herein in their entireties).

As a further alternative, the virus vectors of the invention can be produced in insect cells using baculovirus vectors to deliver the rep/cap genes and rAAV template as described by Urabe et al., (2002) *Human Gene Therapy* 13:1935-43.

Other methods of producing AAV use stably transformed packaging cells (see, e.g., U.S. Pat. No. 5,658,785).

AAV vector stocks free of contaminating helper virus may be obtained by any method known in the art. For example, AAV and helper virus may be readily differentiated based on size. AAV may also be separated away from helper virus based on affinity for a heparin substrate (Zolotukhin et al., (1999) *Gene Therapy* 6:973). In representative embodiments, deleted replication-defective helper viruses are used so that any contaminating helper virus is not replication competent. As a further alternative, an adenovirus helper lacking late gene expression may be employed, as only adenovirus early gene expression is required to mediate packaging of AAV virus. Adenovirus mutants defective for late gene expression are known in the art (e.g., ts100K and ts149 adenovirus mutants).

The inventive packaging methods may be employed to produce high titer stocks of virus particles. In particular embodiments, the virus stock has a titer of at least about $10^5$ transducing units (tu)/ml, at least about $10^6$ tu/ml, at least about $10^7$ tu/ml, at least about $10^8$ tu/ml, at least about $10^9$ tu/ml, or at least about $10^{10}$ tu/ml.

The novel capsid protein and capsid structures find use in raising antibodies, for example, for diagnostic or therapeutic uses or as a research reagent. Thus, the invention also provides antibodies against the novel capsid proteins and capsids of the invention.

The term "antibody" or "antibodies" as used herein refers to all types of immunoglobulins, including IgG, IgM, IgA, IgD, and IgE. The antibody can be monoclonal or polyclonal and can be of any species of origin, including (for example) mouse, rat, rabbit, horse, goat, sheep or human, or can be a chimeric antibody. See, e.g., Walker et al., *Mol. Immunol.* 26, 403-11 (1989). The antibodies can be recombinant monoclonal antibodies, for example, produced according to the methods disclosed in U.S. Pat. Nos. 4,474,893 or 4,816,567. The antibodies can also be chemically constructed, for example, according to the method disclosed in U.S. Pat. No. 4,676,980.

Antibody fragments included within the scope of the present invention include, for example, Fab, F(ab')2, and Fc fragments, and the corresponding fragments obtained from antibodies other than IgG. Such fragments can be produced by known techniques. For example, F(ab')2 fragments can be produced by pepsin digestion of the antibody molecule, and Fab fragments can be generated by reducing the disulfide bridges of the F(ab')2 fragments. Alternatively, Fab expression libraries can be constructed to allow rapid and easy identification of monoclonal Fab fragments with the desired specificity (Huse et al., (1989) *Science* 254, 1275-1281).

Polyclonal antibodies can be produced by immunizing a suitable animal (e.g., rabbit, goat, etc.) with an antigen to which a monoclonal antibody to the target binds, collecting immune serum from the animal, and separating the polyclonal antibodies from the immune serum, in accordance with known procedures.

Monoclonal antibodies can be produced in a hybridoma cell line according to the technique of Kohler and Milstein, (1975) Nature 265, 495-97. For example, a solution containing the appropriate antigen can be injected into a mouse and, after a sufficient time, the mouse sacrificed and spleen cells obtained. The spleen cells are then immortalized by fusing them with myeloma cells or with lymphoma cells, typically in the presence of polyethylene glycol, to produce hybridoma cells. The hybridoma cells are then grown in a suitable medium and the supernatant screened for monoclonal antibodies having the desired specificity. Monoclonal Fab fragments can be produced in *E. coli* by recombinant techniques known to those skilled in the art. See, e.g., W. Huse, (1989) Science 246, 1275-81.

Antibodies specific to a target polypeptide can also be obtained by phage display techniques known in the art.

Various immunoassays can be used for screening to identify antibodies having the desired specificity. Numerous protocols for competitive binding or immunoradiometric assays using either polyclonal or monoclonal antibodies with established specificity are well known in the art. Such immunoassays typically involve the measurement of complex formation between an antigen and its specific antibody (e.g., antigen/antibody complex formation). A two-site, monoclonal-based immunoassay utilizing monoclonal antibodies reactive to two non-interfering epitopes can be used as well as a competitive binding assay.

Antibodies can be conjugated to a solid support (e.g., beads, plates, slides or wells formed from materials such as latex or polystyrene) in accordance with known techniques. Antibodies can likewise be directly or indirectly conjugated to detectable groups such as radiolabels (e.g., $^{35}S$, $^{125}I$, $^{131}I$), enzyme labels (e.g., horseradish peroxidase, alkaline phosphatase), and fluorescence labels (e.g., fluorescein) in accordance with known techniques. Determination of the formation of an antibody/antigen complex in the methods of this invention can be by detection of, for example, precipitation, agglutination, flocculation, radioactivity, color development or change, fluorescence, luminescence, etc., as is well known in the art.

III. Methods of Using Chimeric AAV Capsids Targeted to the CNS

The present invention also relates to methods for delivering heterologous nucleotide sequences into the CNS while minimizing delivery to peripheral organs. The virus vectors of the invention may be employed to deliver a nucleotide sequence of interest to a CNS cell in vitro, e.g., to produce a polypeptide or nucleic acid in vitro or for ex vivo gene therapy. The vectors are additionally useful in a method of delivering a nucleotide sequence to a subject in need thereof, e.g., to express a therapeutic or immunogenic polypeptide or nucleic acid. In this manner, the polypeptide or nucleic acid may thus be produced in vivo in the subject. The subject may be in need of the polypeptide or nucleic acid because the subject has a deficiency of the polypeptide or nucleic acid, or because the production of the polypeptide or nucleic acid in the subject may impart some therapeutic effect, as a method of treatment or otherwise, and as explained further below.

In particular embodiments, the vectors are useful to express a polypeptide or nucleic acid that provides a beneficial effect to the CNS, e.g., to promote growth and/or differentiation of neurons or glial cells. The ability to target vectors to the CNS may be particularly useful to treat diseases or disorders involving CNS dysfunction. In other embodiments, the vectors are useful to express a polypeptide or nucleic acid that provides a beneficial effect to cells in the CNS (e.g., neurons and/or glial cells).

Thus, one aspect of the invention relates to a method of delivering a nucleic acid of interest a CNS cell, the method comprising contacting the CNS cell with the AAV particle of the invention.

In another aspect, the invention relates to a method of delivering a nucleic acid of interest to a CNS cell in a mammalian subject, the method comprising administering an effective amount of the AAV particle or pharmaceutical formulation of the invention to a mammalian subject.

A further aspect of the invention relates to a method of treating a disorder associated with CNS dysfunction in a subject in need thereof, the method comprising administering a therapeutically effective amount of the AAV particle of the invention to the subject.

CNS disorders include but are not limited to disorders of thinking and cognition such as schizophrenia and delirium; amnestic disorders; disorders of mood, such as affective disorders and anxiety disorders (including post-traumatic stress disorder, separation anxiety disorder, selective mutism, reactive attachment disorder, stereotypic movement disorder, panic disorders, agoraphobia, specific phobias, social phobia, obsessive-compulsive disorder, acute stress disorder, generalized anxiety disorder, substance-induced anxiety disorder and/or anxiety disorder not otherwise specified); disorders of social behavior; disorders of learning and memory, such as learning disorders (e.g., dyslexia); motor skills disorders; communication disorders (e.g., stuttering); pervasive developmental disorders (e.g., autistic disorder, Rett's disorder (Rett syndrome), childhood disintegrative disorder, Asperger's disorder, and/or pervasive developmental disorder not otherwise specified) and dementia. Accordingly, the term "central nervous system disorder" encompasses the disorders listed above as well as depressive disorders (including major depressive disorder, dysthmyic disorder, depressive disorder not otherwise specified, post-partum depression); seasonal affective disorder; mania; bipolar disorders (including bipolar I disorder, bipolar II disorder, cyclothymic disorder, bipolar disorder not otherwise specified); attention-deficit and disruptive behavior disorders (including attention deficit disorder with hyperactivity disorder, conduct disorder, oppositional defiant disorder and/or disruptive behavior disorder not otherwise specified); drug addiction/substance abuse (including abuse of opiates, amphetamines, alcohol, hallucinogens, *cannabis*, inhalants, phencyclidine, sedatives, hypnotics, anxyolytics and/or cocaine); alcohol-induced disorders; amphetamine-induced disorders; caffeine-induced disorders; *cannabis*-induced disorders; cocaine-induced disorders; hallucinogen-induced disorders; inhalant-induced disorders; nicotine-induced disorders; opioid-induced disorders; phencyclidine-induced disorders; sedative, hypnotic or anxyolytic-induced disorders; agitation; apathy; psychoses; irritability; disinhibition; schizophreniform disorder; schizoaffective disorder; delusional disorder; brief psychotic disorder, shared psychotic disorder; substance-induced psychotic disorder; psychotic disorder not otherwise specified; unipolar disorders, mood disorders (e.g., mood disorder with psychotic features); somatoform disorders; factitious disorders; disassociative disorders; mental retardation; feeding and eating disorders of infancy or early childhood; eating disorders such as anorexia nervosa, bulimia nervosa and/or eating disorder not otherwise specified; sleeping disorders (e.g., dyssomnias such as primary insomnia, primary hypersomnia, narcolepsy, breathing-related sleep disorder and circadian rhythm sleep disorder and/or parasomnias); impulse control disorders (e.g., kleptomania, pyromania, trichotillomania, pathological gambling and/or intermittent explosive disorder); adjustment disorders; personality disorders (e.g., paranoid personality disorder, schizoid personality disorder, schizotypal personality disorder, antisocial personality disorder, borderline personality disorder, histrionic personality disorder, narcissistic personality disorder, avoidant personality disorder, dependent personality disorder and/or obsessive-compulsive personality disorder); Tic disorders (e.g., Tourette's disorder, chronic motor or vocal tic disorder, transient tic disorder and/or tic disorder not otherwise specified); elimination disorders; and any combination of the foregoing as well as any other disorder or group of disorders described in the Diagnostic and Statistical Manual of Mental Disorders—Fourth Edition (DSM-IV; the American Psychiatric Association, Washington D.C., 1994). "Central Nervous System disorders" also include other conditions that implicate the CNS including but not limited to neurodegenerative disorders such as Alzheimer's disease, involuntary movement disorders such as Parkinson's disease, Huntington's disease, amyotrophic lateral sclerosis (ALS), and the like. Other CNS disorders include without limitation epilepsy, multiple sclerosis, neurogenic pain, psychogenic pain, and migraines.

In one embodiment, the disorder associated with CNS dysfunction is a demyelinating disease. In one embodiment, the disorder associated with CNS dysfunction is multiple sclerosis, Pelizaeus-Merzbacher disease, Krabbe's disease, metachromatic leukodystrophy, adrenoleukodystrophy, Canavan disease, Alexander disease, orthochromatic leukodystrophy, Zellweger disease, 18q-syndrome, cerebral palsy, spinal cord injury, traumatic brain injury, stroke, phenylketonuria, or viral infection, or any other disorder known or later found to be associated with CNS dysfunction. In another embodiment, the methods of the invention are used to treat a disorder that is not directly associated with CNS dysfunction but would benefit by expression of a heterologous polypeptide or nucleic acid in CNS cells. Examples include, without limitation, neurodegenerative disorders such as Alzheimer's disease, Parkinson's disease, and Huntington's disease, CNS tumors, and other CNS disorders.

In other embodiments, the CNS disorder encompasses any subset of the foregoing diseases or excludes any one or more of the foregoing conditions. In particular embodiments, the term "central nervous system disorder" does not encompass benign and/or malignant tumors of the CNS.

In certain embodiments, the CNS disorder is Rett Syndrome. In further embodiments, the invention relates to a method of treating Rett Syndrome in a mammalian subject in need thereof. In certain embodiments, the method comprises administering a therapeutically effective amount of the AAV particle of the invention, e.g., an AAV particle comprising a nucleic acid encoding methyl cytosine binding protein 2.

In another aspect of the invention, the chimeric AAV capsid and vectors of the invention are fully- or nearly fully-detargeted vectors that can be further modified to a desirable tropic profile for targeting of one or more peripheral organs or tissues as discussed below. In this aspect, the present invention also relates to methods for delivering heterologous nucleotide sequences into a broad range of cells, including dividing and non-dividing cells. The virus vectors of the invention may be employed to deliver a nucleotide sequence of interest to a cell in vitro, e.g., to produce a polypeptide in vitro or for ex vivo gene therapy. The vectors are additionally useful in a method of delivering a nucleotide sequence to a subject in need thereof, e.g., to express a therapeutic or immunogenic polypeptide or nucleic acid. In this manner, the polypeptide or nucleic acid may thus be produced in vivo in the subject. The subject may be in need of the polypeptide or nucleic acid because the subject has a deficiency of the polypeptide, or because the production of the polypeptide or nucleic acid in the subject may impart some therapeutic effect, as a method of treatment or otherwise, and as explained further below.

In general, the virus vectors of the invention may be employed to deliver any foreign nucleic acid with a biological effect to treat or ameliorate the symptoms associated with any disorder related to gene expression. Further, the invention can be used to treat any disease state for which it is beneficial to deliver a therapeutic polypeptide. Illustrative disease states include, but are not limited to: cystic fibrosis (cystic fibrosis transmembrane regulator protein) and other diseases of the lung, hemophilia A (Factor VIII), hemophilia B (Factor IX), thalassemia (β-globin), anemia (erythropoietin) and other blood disorders, Alzheimer's disease (GDF; neprilysin), multiple sclerosis (β-interferon), Parkinson's disease (glial-cell line derived neurotrophic factor [GDNF]), Huntington's disease (inhibitory RNA including without limitation RNAi such as siRNA or shRNA, antisense RNA or microRNA to remove repeats), amyotrophic lateral sclerosis, epilepsy (galanin, neurotrophic factors), and other neurological disorders, cancer (endostatin, angiostatin, TRAIL, FAS-ligand, cytokines including interferons; inhibitory RNA including without limitation RNAi (such as siRNA or shRNA), antisense RNA and microRNA including inhibitory RNA against VEGF, the multiple drug resistance gene product or a cancer immunogen), diabetes mellitus (insulin, PGC-α1, GLP-1, myostatin pro-peptide, glucose transporter 4), muscular dystrophies including Duchenne and Becker (e.g., dystrophin, mini-dystrophin, micro-dystrophin, insulin-like growth factor I, a sarcoglycan [e.g., α, β, γ], Inhibitory RNA [e.g., RNAi, antisense RNA or microRNA] against myostatin or myostatin propeptide, laminin-alpha2, Fukutin-related protein, dominant negative myostatin, follistatin, activin type II soluble receptor, anti-inflammatory polypeptides such as the Ikappa B dominant mutant, sarcospan, utrophin, mini-utrophin, inhibitory RNA [e.g., RNAi, antisense RNA or microRNA] against splice junctions in the dystrophin gene to induce exon skipping [see, e.g., WO/2003/095647], inhibitory RNA (e.g., RNAi, antisense RNA or micro RNA] against U7 snRNAs to induce exon skipping [see, e.g., WO/2006/021724], and antibodies or antibody fragments against myostatin or myostatin propeptide), Gaucher disease (glucocerebrosidase), Hurler's disease (α-L-iduronidase), adenosine deaminase deficiency (adenosine deaminase), glycogen storage diseases (e.g., Fabry disease [α-galactosidase] and Pompe disease [lysosomal acid α-glucosidase]) and other metabolic defects including other lysosomal storage disorders and glycogen storage disorders, congenital emphysema (α1-antitrypsin), Lesch-Nyhan Syndrome (hypoxanthine guanine phosphoribosyl transferase), Niemann-Pick disease (sphingomyelinase), Maple Syrup Urine Disease (branched-chain keto acid dehydrogenase), retinal degenerative diseases (and other diseases of the eye and retina; e.g., PDGF, endostatin and/or angiostatin for macular degeneration), diseases of solid organs such as brain (including Parkinson's Disease [GDNF], astrocytomas [endostatin, angiostatin and/or RNAi against VEGF], glioblastomas [endostatin, angiostatin and/or RNAi against VEGF]), liver (RNAi such as siRNA or shRNA, microRNA or antisense RNA for hepatitis B and/or hepatitis C genes), kidney, heart including congestive heart failure or peripheral artery disease (PAD) (e.g., by delivering protein phosphatase inhibitor I [I-1], phospholamban, sarcoplasmic endoreticulum $Ca^{2+}$-ATPase [serca2a], zinc finger proteins that regulate the phospholamban gene, Pim-1, PGC-1α, SOD-1, SOD-2, ECF-SOD, kallikrein, thymosin-β4, hypoxia-inducible transcription factor [HIF], βarkct, β2-adrenergic receptor, β2-adrenergic receptor kinase [βARK], phosphoinositide-3 kinase [PI3 kinase], calsarcin, an angiogenic factor, S100A1, parvalbumin, adenylyl cyclase type 6, a molecule that effects G-protein coupled receptor kinase type 2 knockdown such as a truncated constitutively active bARKct, an inhibitory RNA [e.g., RNAi, antisense RNA or microRNA] against phospholamban; phospholamban inhibitory or dominant-negative molecules such as phospholamban S16E, etc.), arthritis (insulin-like growth factors), joint disorders (insulin-like growth factors), intimal hyperplasia (e.g., by delivering enos, inos), improve survival of heart transplants (superoxide dismutase), AIDS (soluble CD4), muscle wasting (insulin-like growth factor I, myostatin pro-peptide, an anti-apoptotic factor, follistatin), limb ischemia (VEGF, FGF, PGC-1α, EC-SOD, HIF), kidney deficiency (erythropoietin), anemia (erythropoietin), arthritis (anti-inflammatory factors such as IRAP and TNFα soluble receptor), hepatitis (α-interferon), LDL receptor deficiency (LDL receptor), hyperammonemia (ornithine transcarbamylase), spinal cerebral ataxias including SCA1, SCA2 and SCA3, phenylketonuria (phenylalanine hydroxylase), autoimmune diseases, and the like. The invention can further be used following organ transplantation to increase the success of the transplant and/or to reduce the negative side effects of organ transplantation or adjunct therapies (e.g., by administering immunosuppressant agents or inhibitory nucleic acids to block cytokine production). As another example, bone morphogenic proteins (including RANKL and/or VEGF) can be administered with a bone allograft, for example, following a break or surgical removal in a cancer patient.

Exemplary lysosomal storage diseases that can be treated according to the present invention include without limitation: Hurler's Syndrome (MPS IH), Scheie's Syndrome (MPS IS), and Hurler-Scheie Syndrome (MPS THIS) (α-L-iduronidase); Hunter's Syndrome (MPS II) (iduronate sulfate sulfatase); Sanfilippo A Syndrome (MPS IIIA) (Heparan-S-sulfate sulfaminidase), Sanfilippo B Syndrome (MPS MB) (N-acetyl-D-glucosaminidase), Sanfilippo C Syndrome (MPS IIIC) (Acetyl-CoA-glucosaminide N-acetyltransferase), Sanfilippo D Syndrome (MPS IIID) (N-acetyl-glucosaminine-6-sulfate sulfatase); Morquio A disease (MPS IVA) (Galactosamine-6-sulfate sulfatase), Morquio B disease (MPS IV B) (β-Galactosidase); Maroteaux-lmay disease (MPS VI) (arylsulfatase B); Sly Syndrome (MPS VII) (β-glucuronidase); hyaluronidase deficiency (MPS IX) (hyaluronidase); sialidosis (mucolipidosis I), mucolipidosis II (I-Cell disease) (N-actylglucos-aminyl-1-phosphotransferase catalytic subunit), mucolipidosis III (pseudo-Hurler polydystrophy) (N-acetylglucos-aminyl-1-phosphotransferase; type IIIA [catalytic subunit] and type IIIC [substrate recognition subunit]); GM1 gangliosidosis (ganglioside β-galactosidase), GM2 gangliosidosis Type I (Tay-Sachs disease) (β-hexaminidase A), GM2 gangliosidosis type II (Sandhoff's disease) (β-hexosaminidase B); Niemann-Pick disease (Types A and B) (sphingomyelinase); Gaucher's disease (glucocerebrosidase); Farber's disease (ceraminidase); Fabry's disease (α-galactosidase A); Krabbe's disease (galactosylceramide β-galactosidase); metachromatic leukodystrophy (arylsulfatase A); lysosomal acid lipase deficiency including Wolman's disease (lysosomal acid lipase); Batten disease (juvenile neuronal ceroid lipofuscinosis) (lysosomal trans-membrane CLN3 protein) sialidosis (neuraminidase 1); galactosialidosis (Goldberg's syndrome) (protective protein/cathepsin A); α-mannosidosis (α-D-mannosidase); β-mannosidosis (β-D-mannosidosis); fucosidosis (α-D-fucosidase); aspartylglucosaminuria (N-Aspartylglucosaminidase); and sialuria (Na phosphate cotransporter).

Exemplary glycogen storage diseases that can be treated according to the present invention include, but are not limited to, Type Ia GSD (von Gierke disease) (glucose-6-phosphatase), Type Ib GSD (glucose-6-phosphate translocase), Type Ic GSD (microsomal phosphate or pyrophosphate transporter), Type Id GSD (microsomal glucose transporter), Type II GSD including Pompe disease or infantile Type IIa GSD (lysosomal acid α-glucosidase) and Type IIb (Danon) (lysosomal membrane protein-2), Type IIIa and IIIb GSD (Debrancher enzyme; amyloglucosidase and oligoglucanotransferase), Type IV GSD (Andersen's disease) (branching enzyme), Type V GSD (McArdle disease) (muscle phosphorylase), Type VI GSD (Hers' disease) (liver phosphorylase), Type VII GSD (Tarui's disease) (phosphofructokinase), GSD Type VIII/IXa (X-linked phosphorylase kinase), GSD Type IXb (Liver and muscle phosphorylase kinase), GSD Type IXc (liver phosphorylase kinase), GSD Type IXd (muscle phosphorylase kinase), GSD O (glycogen synthase), Fanconi-Bickel syndrome (glucose transporter-2), phosphoglucoisomerase deficiency, muscle phosphoglycerate kinase deficiency, phosphoglycerate mutase deficiency, fructose 1,6-diphosphatase deficiency, phosphoenolpyruvate carboxykinase deficiency, and lactate dehydrogenase deficiency.

Nucleic acids and polypeptides that can be delivered to cardiac muscle include those that are beneficial in the treatment of damaged, degenerated or atrophied cardiac muscle and/or congenital cardiac defects. For example, angiogenic factors useful for facilitating vascularization in the treatment of heart disease include but are not limited to vascular endothelial growth factor (VEGF), VEGF II, VEGF-B, VEGF-C, VEGF-D, VEGF-E, $VEGF_{121}$, $VEGF_{138}$, $VEGF_{145}$, $VEGF_{165}$, $VEGF_{189}$, $VEGF_{206}$, hypoxia inducible factor 1α (HIF 1α), endothelial NO synthase (eNOS), iNOS, VEFGR-1 (Flt1), VEGFR-2 (KDR/Flk1), VEGFR-3 (Flt4), angiogenin, epidermal growth factor (EGF), angiopoietin, platelet-derived growth factor, angiogenic factor, transforming growth factor-α (TGF-α), transforming growth factor-β (TGF-β), vascular permeability factor (VPF), tumor necrosis factor alpha (TNF-α), interleukin-3 (IL-3), interleukin-8 (IL-8), platelet-derived endothelial growth factor (PD-EGF), granulocyte colony stimulating factor (G-CSF), hepatocyte growth factor (HGF), scatter factor (SF), pleitrophin, proliferin, follistatin, placental growth factor (PIGF), midkine, platelet-derived growth factor-BB (PDGF), fractalkine, ICAM-1, angiopoietin-1 and -2 (Ang1 and Ang2), Tie-2, neuropilin-1, ICAM-1, chemokines and cytokines that stimulate smooth muscle cell, monocyte, or leukocyte migration, anti-apoptotic peptides and proteins, fibroblast growth factors (FGF), FGF-1, FGF-1b, FGF-1c, FGF-2, FGF-2b, FGF-2c, FGF-3, FGF-3b, FGF-3c, FGF-4, FGF-5, FGF-7, FGF-9, acidic FGF, basic FGF, monocyte chemotactic protein-1, granulocyte macrophage-colony stimulating factor, insulin-like growth factor-1 (IGF-1), IGF-2, early growth response factor-1 (EGR-1), ETS-1, human tissue kallikrein (HK), matrix metalloproteinase, chymase, urokinase-type plasminogen activator and heparinase. (see, e.g., U.S. Patent Application No. 20060287259 and U.S. Patent Application No. 20070059288).

The most common congenital heart disease found in adults is bicuspid aortic valve, whereas atrial septal defect is responsible for 30-40% of congenital heart disease seen in adults. The most common congenital cardiac defect observed in the pediatric population is ventricular septal defect. Other congenital heart diseases include Eisenmenger's syndrome, patent ductus arteriosus, pulmonary stenosis, coarctation of the aorta, transposition of the great arteries, tricuspid atresia, univentricular heart, Ebstein's anomaly, and double-outlet right ventricle. A number of studies have identified putative genetic loci associated with one or more of these congenital heart diseases. For example, the putative gene(s) for congenital heart disease associated with Down syndrome is 21q22.2-q22.3, between ETS2 and MX1. Similarly, most cases of DiGeorge syndrome result from a deletion of chromosome 22q11.2 (the DiGeorge syndrome chromosome region, or DGCR). Several genes are lost in this deletion including the putative transcription factor TUPLE1. This deletion is associated with a variety of phenotypes, e.g., Shprintzen syndrome; conotruncal anomaly face (or Takao syndrome); and isolated outflow tract defects of the heart including Tetralogy of Fallot, truncus arteriosus, and interrupted aortic arch. All of the foregoing disorders can be treated according to the present invention.

Other significant diseases of the heart and vascular system are also believed to have a genetic, typically polygenic, etiological component. These diseases include, for example, hypoplastic left heart syndrome, cardiac valvular dysplasia, Pfeiffer cardiocranial syndrome, oculofaciocardiodental syndrome, Kapur-Toriello syndrome, Sonoda syndrome, Ohdo Blepharophimosis syndrome, heart-hand syndrome, Pierre-Robin syndrome, Hirschsprung disease, Kousseff syndrome, Grange occlusive arterial syndrome, Kearns-Sayre syndrome, Kartagener syndrome, Alagille syndrome, Ritscher-Schinzel syndrome, Ivemark syndrome, Young-Simpson syndrome, hemochromatosis, Holzgreve syndrome, Barth syndrome, Smith-Lemli-Opitz syndrome, glycogen storage disease, Gaucher-like disease, Fabry disease, Lowry-Maclean syndrome, Rett syndrome, Opitz syndrome, Marfan syndrome, Miller-Dieker lissencephaly syndrome, mucopolysaccharidosis, Bruada syndrome, humerospinal dysostosis, Phaver syndrome, McDonough syndrome, Marfanoid hypermobility syndrome, atransferrinemia, Cornelia de Lange syndrome, Leopard syndrome, Diamond-Blackfan anemia, Steinfeld syndrome, progeria, and Williams-Beuren syndrome. All of these disorders can be treated according to the present invention.

Anti-apoptotic factors can be delivered to skeletal muscle, diaphragm muscle and/or cardiac muscle to treat muscle wasting diseases, limb ischemia, cardiac infarction, heart failure, coronary artery disease and/or type I or type II diabetes.

Nucleic acids that can be delivered to skeletal muscle include those that are beneficial in the treatment of damaged, degenerated and/or atrophied skeletal muscle. The genetic defects that cause muscular dystrophy are known for many forms of the disease. These defective genes either fail to produce a protein product, produce a protein product that fails to function properly, or produce a dysfunctional protein product that interferes with the proper function of the cell. The heterologous nucleic acid may encode a therapeutically functional protein or a polynucleotide that inhibits production or activity of a dysfunctional protein. Polypeptides that may be expressed from delivered nucleic acids, or inhibited by delivered nucleic acids (e.g., by delivering RNAi, microRNA or antisense RNA), include without limitation dystrophin, a mini-dystrophin or a micro-dystrophin (Duchene's and Becker MD); dystrophin-associated glycoproteins β-sarcoglycan (limb-girdle MD 2E), δ-sarcoglycan (limb-girdle MD 2 2F), α-sarcoglycan (limb girdle MD 2D) and γ-sarcoglycan (limb-girdle MD 2C), utrophin, calpain (autosomal recessive limb-girdle MD type 2A), caveolin-3 (autosomal-dominant limb-girdle MD), laminin-alpha2 (merosin-deficient congenital MD), miniagrin (laminin-alpha2 deficient congenital MD), fukutin (Fukuyama type congenital MD), emerin (Emery-Dreifuss MD), myotilin, lamin A/C, calpain-3, dysferlin, and/or telethonin. Further, the heterologous nucleic acid can encode mir-1, mir-133, mir-206, mir-208 or an antisense RNA, RNAi (e.g., siRNA or shRNA) or microRNA to induce exon skipping in a defective dystrophin gene.

In particular embodiments, the nucleic acid is delivered to tongue muscle (e.g., to treat dystrophic tongue). Methods of delivering to the tongue can be by any method known in the art including direct injection, oral administration, topical administration to the tongue, intravenous administration, intra-articular administration and the like.

The foregoing proteins can also be administered to diaphragm muscle to treat muscular dystrophy.

Alternatively, a gene transfer vector may be administered that encodes any other therapeutic polypeptide.

In particular embodiments, a virus vector according to the present invention is used to deliver a nucleic acid of interest as described herein to skeletal muscle, diaphragm muscle and/or cardiac muscle, for example, to treat a disorder associated with one or more of these tissues such as muscular dystrophy, heart disease (including PAD and congestive heart failure), and the like.

Gene transfer has substantial potential use in understanding and providing therapy for disease states. There are a number of inherited diseases in which defective genes are known and have been cloned. In general, the above disease states fall into two classes: deficiency states, usually of enzymes, which are generally inherited in a recessive manner, and unbalanced states, which may involve regulatory or structural proteins, and which are typically inherited in a dominant manner. For deficiency state diseases, gene transfer can be used to bring a normal gene into affected tissues for replacement therapy, as well as to create animal models for the disease using inhibitory RNA such as RNAi (e.g., siRNA or shRNA), microRNA or antisense RNA. For unbalanced disease states, gene transfer can be used to create a disease state in a model system, which can then be used in efforts to counteract the disease state. Thus, the virus vectors according to the present invention permit the treatment of genetic diseases. As used herein, a disease state is treated by partially or wholly remedying the deficiency or imbalance that causes the disease or makes it more severe. The use of site-specific recombination of nucleic sequences to cause mutations or to correct defects is also possible.

The virus vectors according to the present invention may also be employed to provide an antisense nucleic acid or inhibitory RNA (e.g., microRNA or RNAi such as a siRNA or shRNA) to a cell in vitro or in vivo. Expression of the inhibitory RNA in the target cell diminishes expression of a particular protein(s) by the cell. Accordingly, inhibitory RNA may be administered to decrease expression of a particular protein in a subject in need thereof. Inhibitory RNA may also be administered to cells in vitro to regulate cell physiology, e.g., to optimize cell or tissue culture systems.

As a further aspect, the virus vectors of the present invention may be used to produce an immune response in a subject. According to this embodiment, a virus vector comprising a nucleic acid encoding an immunogen may be administered to a subject, and an active immune response (optionally, a protective immune response) is mounted by the subject against the immunogen. Immunogens are as described hereinabove.

Alternatively, the virus vector may be administered to a cell ex vivo and the altered cell is administered to the subject. The heterologous nucleic acid is introduced into the cell, and the cell is administered to the subject, where the heterologous nucleic acid encoding the immunogen is optionally expressed and induces an immune response in the subject against the immunogen. In particular embodiments, the cell is an antigen-presenting cell (e.g., a dendritic cell).

An "active immune response" or "active immunity" is characterized by "participation of host tissues and cells after an encounter with the immunogen. It involves differentiation and proliferation of immunocompetent cells in lymphoreticular tissues, which lead to synthesis of antibody or the development of cell-mediated reactivity, or both." Herbert B. Herscowitz, *Immunophysiology: Cell Function and Cellular Interactions in Antibody Formation*, in IMMUNOLOGY: BASIC PROCESSES 117 (Joseph A. Bellanti ed., 1985). Alternatively stated, an active immune response is mounted by the host after exposure to immunogens by infection or by vaccination. Active immunity can be contrasted with passive immunity, which is acquired through the "transfer of preformed substances (antibody, transfer factor, thymic graft, interleukin-2) from an actively immunized host to a non-immune host." Id.

A "protective" immune response or "protective" immunity as used herein indicates that the immune response confers some benefit to the subject in that it prevents or reduces the incidence of disease. Alternatively, a protective immune response or protective immunity may be useful in the treatment of disease, in particular cancer or tumors (e.g., by causing regression of a cancer or tumor and/or by preventing metastasis and/or by preventing growth of metastatic nodules). The protective effects may be complete or partial, as long as the benefits of the treatment outweigh any disadvantages thereof.

The virus vectors of the present invention may also be administered for cancer immunotherapy by administration of a viral vector expressing a cancer cell antigen (or an immunologically similar molecule) or any other immunogen that produces an immune response against a cancer cell. To illustrate, an immune response may be produced against a cancer cell antigen in a subject by administering a viral vector comprising a heterologous nucleotide sequence encoding the cancer cell antigen, for example to treat a patient with cancer. The virus vector may be administered to a subject in vivo or by using ex vivo methods, as described herein.

As used herein, the term "cancer" encompasses tumor-forming cancers. Likewise, the term "cancerous tissue" encompasses tumors. A "cancer cell antigen" encompasses tumor antigens.

The term "cancer" has its understood meaning in the art, for example, an uncontrolled growth of tissue that has the potential to spread to distant sites of the body (i.e., metastasize). Exemplary cancers include, but are not limited to, leukemia, lymphoma (e.g., Hodgkin and non-Hodgkin lymphomas), colorectal cancer, renal cancer, liver cancer, breast cancer, lung cancer, prostate cancer, testicular cancer, ovarian cancer, uterine cancer, cervical cancer, brain cancer (e.g., gliomas and glioblastoma), bone cancer, sarcoma, melanoma, head and neck cancer, esophageal cancer, thyroid cancer, and the like. In embodiments of the invention, the invention is practiced to treat and/or prevent tumor-forming cancers.

The term "tumor" is also understood in the art, for example, as an abnormal mass of undifferentiated cells within a multicellular organism. Tumors can be malignant or benign. In representative embodiments, the methods disclosed herein are used to prevent and treat malignant tumors.

Cancer cell antigens have been described hereinabove. By the terms "treating cancer" or "treatment of cancer," it is intended that the severity of the cancer is reduced or the cancer is prevented or at least partially eliminated. For example, in particular contexts, these terms indicate that metastasis of the cancer is prevented or reduced or at least partially eliminated. In further representative embodiments these terms indicate that growth of metastatic nodules (e.g., after surgical removal of a primary tumor) is prevented or reduced or at least partially eliminated. By the terms "prevention of cancer" or "preventing cancer" it is intended that the methods at least partially eliminate or reduce the incidence or onset of cancer. Alternatively stated, the onset or progression of cancer in the subject may be slowed, controlled, decreased in likelihood or probability, or delayed.

In particular embodiments, cells may be removed from a subject with cancer and contacted with a virus vector according to the present invention. The modified cell is then administered to the subject, whereby an immune response against the cancer cell antigen is elicited. This method is particularly advantageously employed with immunocompromised subjects that cannot mount a sufficient immune response in vivo (i.e., cannot produce enhancing antibodies in sufficient quantities).

It is known in the art that immune responses may be enhanced by immunomodulatory cytokines (e.g., α-interferon, β-interferon, γ-interferon, ω-interferon, τ-interferon, interleukin-1α, interleukin-1β, interleukin-2, interleukin-3, interleukin-4, interleukin 5, interleukin-6, interleukin-7, interleukin-8, interleukin-9, interleukin-10, interleukin-11, interleukin 12, interleukin-13, interleukin-14, interleukin-18, B cell Growth factor, CD40 Ligand, tumor necrosis factor-α, tumor necrosis factor-β, monocyte chemoattractant protein-1, granulocyte-macrophage colony stimulating factor, and lymphotoxin). Accordingly, immunomodulatory cytokines (e.g., CTL inductive cytokines) may be administered to a subject in conjunction with the virus vectors.

Cytokines may be administered by any method known in the art. Exogenous cytokines may be administered to the subject, or alternatively, a nucleotide sequence encoding a cytokine may be delivered to the subject using a suitable vector, and the cytokine produced in vivo.

The viral vectors are further useful for targeting CNS cells for research purposes, e.g., for study of CNS function in vitro or in animals or for use in creating and/or studying animal models of disease. For example, the vectors can be used to deliver heterologous nucleic acids to neurons in animal models of neural injury, e.g., traumatic brain injury or spinal cord injury or animal models of neurodegenerative diseases. For example, the vectors can be used to deliver heterologous nucleic acids to oligodendrocytes in animal models of demyelinating diseases. Demyelination can be induced in animals by a variety of means, including without limitation administration of viruses (e.g., Semliki virus, murine hepatitis virus, or Theiler's murine encephalomyelitis virus) and administration of chemicals (e.g., cuprizone, ethidium bromide, or lysolecithin). In some embodiments, the vector can also be used in animal models of experimental autoimmune encephalomyelitis. This condition can be induced by, for example, administration of kainite, SIN-1, anti-galactocerebroside, or irradiation. In other embodiments, the viral vector can be used to specifically deliver to oligodendrocytes a toxic agent or an enzyme that produces a toxic agent (e.g., thymidine kinase) in order to kill some or all of the cells.

Further, the virus vectors according to the present invention find further use in diagnostic and screening methods, whereby a gene of interest is transiently or stably expressed in a cell culture system, or alternatively, a transgenic animal model. The invention can also be practiced to deliver a nucleic acid for the purposes of protein production, e.g., for laboratory, industrial or commercial purposes.

Recombinant virus vectors according to the present invention find use in both veterinary and medical applications. Suitable subjects include both avians and mammals. The term "avian" as used herein includes, but is not limited to, chickens, ducks, geese, quail, turkeys, pheasant, parrots, parakeets. The term "mammal" as used herein includes, but is not limited to, humans, primates non-human primates (e.g., monkeys and baboons), cattle, sheep, goats, pigs, horses, cats, dogs, rabbits, rodents (e.g., rats, mice, hamsters, and the like), etc. Human subjects include neonates, infants, juveniles, and adults. Optionally, the subject is "in need of" the methods of the present invention, e.g., because the subject has or is believed at risk for a disorder including those described herein or that would benefit from the delivery of a nucleic acid including those described herein. For example, in particular embodiments, the subject has (or has had) or is at risk for a demyelinating disorder or a spinal cord or brain injury. As a further option, the subject can be a laboratory animal and/or an animal model of disease.

In particular embodiments, the present invention provides a pharmaceutical composition comprising a virus vector of the invention in a pharmaceutically acceptable carrier and, optionally, other medicinal agents, pharmaceutical agents, stabilizing agents, buffers, carriers, adjuvants, diluents, etc. For injection, the carrier will typically be a liquid. For other methods of administration, the carrier may be either solid or liquid. For inhalation administration, the carrier will be respirable, and will preferably be in solid or liquid particulate form.

By "pharmaceutically acceptable" it is meant a material that is not toxic or otherwise undesirable, i.e., the material may be administered to a subject without causing any undesirable biological effects.

One aspect of the present invention is a method of transferring a nucleotide sequence to a cell in vitro. The virus vector may be introduced to the cells at the appropriate multiplicity of infection according to standard transduction methods appropriate for the particular target cells. Titers of the virus vector or capsid to administer can vary, depending upon the target cell type and number, and the particular virus vector or capsid, and can be determined by those of skill in the art without undue experimentation. In particular embodiments, at least about $10^3$ infectious units, more preferably at least about $10^5$ infectious units are introduced to the cell.

The cell(s) into which the virus vector can be introduced may be of any type, including but not limited to neural cells (including cells of the peripheral and central nervous systems, in particular, brain cells such as neurons, oligodendrocytes, glial cells, astrocytes), lung cells, cells of the eye (including retinal cells, retinal pigment epithelium, and corneal cells), epithelial cells (e.g., gut and respiratory epithelial cells), skeletal muscle cells (including myoblasts, myotubes and myofibers), diaphragm muscle cells, dendritic cells, pancreatic cells (including islet cells), hepatic cells, a cell of the gastrointestinal tract (including smooth muscle cells, epithelial cells), heart cells (including cardiomyocytes), bone cells (e.g., bone marrow stem cells), hematopoietic stem cells, spleen cells, keratinocytes, fibroblasts, endothelial cells, prostate cells, joint cells (including, e.g., cartilage, meniscus, synovium and bone marrow), germ cells, and the like. Alternatively, the cell may be any progenitor cell. As a further alternative, the cell can be a stem cell (e.g., neural stem cell, liver stem cell). As still a further alternative, the cell may be a cancer or tumor cell (cancers and tumors are described above). Moreover, the cells can be from any species of origin, as indicated above.

The virus vectors may be introduced to cells in vitro for the purpose of administering the modified cell to a subject. In particular embodiments, the cells have been removed from a subject, the virus vector is introduced therein, and the cells are then replaced back into the subject. Methods of removing cells from subject for treatment ex vivo, followed by introduction back into the subject are known in the art (see, e.g., U.S. Pat. No. 5,399,346). Alternatively, the recombinant virus vector is introduced into cells from another subject, into cultured cells, or into cells from any other suitable source, and the cells are administered to a subject in need thereof.

Suitable cells for ex vivo gene therapy are as described above. Dosages of the cells to administer to a subject will vary upon the age, condition and species of the subject, the type of cell, the nucleic acid being expressed by the cell, the mode of administration, and the like. Typically, at least about $10^2$ to about $10^8$ or about $10^3$ to about $10^6$ cells will be administered per dose in a pharmaceutically acceptable carrier. In particular embodiments, the cells transduced with the virus vector are administered to the subject in an effective amount in combination with a pharmaceutical carrier.

In some embodiments, cells that have been transduced with the virus vector may be administered to elicit an immunogenic response against the delivered polypeptide (e.g., expressed as a transgene or in the capsid). Typically, a quantity of cells expressing an effective amount of the polypeptide in combination with a pharmaceutically acceptable carrier is administered. Optionally, the dosage is sufficient to produce a protective immune response (as defined above). The degree of protection conferred need not be complete or permanent, as long as the benefits of administering the immunogenic polypeptide outweigh any disadvantages thereof.

A further aspect of the invention is a method of administering the virus vectors or capsids of the invention to subjects. In particular embodiments, the method comprises a method of delivering a nucleic acid of interest to an animal subject, the method comprising: administering an effective amount of a virus vector according to the invention to an animal subject. Administration of the virus vectors of the present invention to a human subject or an animal in need thereof can be by any means known in the art. Optionally, the virus vector is delivered in an effective dose in a pharmaceutically acceptable carrier.

The virus vectors of the invention can further be administered to a subject to elicit an immunogenic response (e.g., as a vaccine). Typically, vaccines of the present invention comprise an effective amount of virus in combination with a pharmaceutically acceptable carrier. Optionally, the dosage is sufficient to produce a protective immune response (as defined above). The degree of protection conferred need not be complete or permanent, as long as the benefits of administering the immunogenic polypeptide outweigh any disadvantages thereof. Subjects and immunogens are as described above.

Dosages of the virus vectors to be administered to a subject will depend upon the mode of administration, the disease or condition to be treated, the individual subject's condition, the particular virus vector, and the nucleic acid to be delivered, and can be determined in a routine manner. Exemplary doses for achieving therapeutic effects are virus titers of at least about $10^5$, $10^6$, $10^7$, $10^8$, $10^9$, $10^{10}$, $10^{11}$, $10^{12}$, $10^3$, $10^{14}$, $10^{15}$ transducing units or more, preferably about $10^7$ or $10^8$, $10^9$, $10^{10}$, $10^{11}$, $10^{12}$, $10^{13}$ or $10^{14}$ transducing units, yet more preferably about $10^{12}$ transducing units.

In particular embodiments, more than one administration (e.g., two, three, four or more administrations) may be employed to achieve the desired level of gene expression over a period of various intervals, e.g., daily, weekly, monthly, yearly, etc.

Exemplary modes of administration include oral, rectal, transmucosal, topical, intranasal, inhalation (e.g., via an aerosol), buccal (e.g., sublingual), vaginal, intrathecal, intraocular, transdermal, in utero (or in ovo), parenteral (e.g., intravenous, subcutaneous, intradermal, intramuscular [including administration to skeletal, diaphragm and/or cardiac muscle], intradermal, intrapleural, intracerebral, and intraarticular), topical (e.g., to both skin and mucosal surfaces, including airway surfaces, and transdermal administration), intro-lymphatic, and the like, as well as direct tissue or organ injection (e.g., to liver, skeletal muscle, cardiac muscle, diaphragm muscle or brain). Administration can also be to a tumor (e.g., in or a near a tumor or a lymph node). The most suitable route in any given case will depend on the nature and severity of the condition being treated and on the nature of the particular vector that is being used.

In some embodiments, the viral vector is administered directly to the CNS, e.g., the brain or the spinal cord. Direct administration can result in high specificity of transduction of CNS cells, e.g., wherein at least 80%, 85%, 90%, 95% or more of the transduced cells are CNS cells. Any method known in the art to administer vectors directly to the CNS can be used. The vector may be introduced into the spinal cord, brainstem (medulla oblongata, pons), midbrain (hypothalamus, thalamus, epithalamus, pituitary gland, substantia nigra, pineal gland), cerebellum, telencephalon (corpus striatum, cerebrum including the occipital, temporal, parietal and frontal lobes, cortex, basal ganglia, hippocampus and amygdala), limbic system, neocortex, corpus striatum, cerebrum, and inferior colliculus. The vector may also be administered to different regions of the eye such as the retina, cornea or optic nerve. The vector may be delivered into the cerebrospinal fluid (e.g., by lumbar puncture) for more disperse administration of the vector.

The delivery vector may be administered to the desired region(s) of the CNS by any route known in the art, including but not limited to, intrathecal, intracerebral, intraventricular, intranasal, intra-aural, intra-ocular (e.g., intravitreous, sub-retinal, anterior chamber) and peri-ocular (e.g., sub-Tenon's region) delivery or any combination thereof.

Typically, the viral vector will be administered in a liquid formulation by direct injection (e.g., stereotactic injection) to the desired region or compartment in the CNS. In some embodiments, the vector can be delivered via a reservoir and/or pump. In other embodiments, the vector may be provided by topical application to the desired region or by intra-nasal administration of an aerosol formulation. Administration to the eye or into the ear, may be by topical application of liquid droplets. As a further alternative, the vector may be administered as a solid, slow-release formulation. Controlled release of parvovirus and AAV vectors is described by international patent publication WO 01/91803.

In some embodiments where the subject has a compromised blood-brain barrier (BBB), the viral vector can be delivered systemically (e.g., intravenously) to the subject, wherein the vector transduces CNS cells in the area of (e.g., bordering) the BBB compromise. In certain embodiments, the vector transduces cells in the compromised area but not cells in uncompromised areas. Thus, one aspect of the invention relates to a method of delivering a nucleic acid of interest to an area of the CNS bordering a compromised blood brain barrier area in a mammalian subject, the method comprising intravenously administering an effective amount of the AAV particle of the invention.

In some embodiments, the compromise in the BBB is due to a disease or disorder, Examples include, without limitation, neurodegenerative diseases such as Alzheimer's, Parkinson's disease, disease, amyotrophic lateral sclerosis, and multiple sclerosis, epilepsy, CNS tumors, or cerebral infarcts. In other embodiments, the BBB compromise can be an induced disruption, e.g., to promote delivery of agents to the CNS. Temporary BBB compromises can be induced by, for example, toxic chemicals (such as metrazol, VP-16, cisplatin, hydroxyurea, fluorouracil, and etoposide), osmotic agents (such as mannitol and arabinose), biological agents (such as retinoic acid, phorbol myristate acetate, leukotriene C4, bradykinin, histamine, RMP-7, and alkylglycerols), or irradiation (such as ultrasound or electromagnetic radiation).

Administration to skeletal muscle according to the present invention includes but is not limited to administration to skeletal muscles in the limbs (e.g., upper arm, lower arm, upper leg, and/or lower leg), back, neck, head (e.g., tongue), thorax, abdomen, pelvis/perineum, and/or digits. Suitable skeletal muscle tissues include but are not limited to abductor digiti minimi (in the hand), abductor digiti minimi (in the foot), abductor hallucis, abductor ossis metatarsi quinti, abductor pollicis brevis, abductor pollicis longus, adductor brevis, adductor hallucis, adductor longus, adductor magnus, adductor pollicis, anconeus, anterior scalene, articularis genus, biceps brachii, biceps femoris, brachialis, brachioradialis, buccinator, coracobrachialis, corrugator supercilii, deltoid, depressor anguli oris, depressor labii inferioris, digastric, dorsal interossei (in the hand), dorsal interossei (in the foot), extensor carpi radialis brevis, extensor carpi radialis longus, extensor carpi ulnaris, extensor digiti minimi, extensor digitorum, extensor digitorum brevis, extensor digitorum longus, extensor hallucis brevis, extensor hallucis longus, extensor indicis, extensor pollicis brevis, extensor pollicis longus, flexor carpi radialis, flexor carpi ulnaris, flexor digiti minimi brevis (in the hand), flexor digiti minimi brevis (in the foot), flexor digitorum brevis, flexor digitorum longus, flexor digitorum profundus, flexor digitorum superficialis, flexor hallucis brevis, flexor hallucis longus, flexor pollicis brevis, flexor pollicis longus, frontalis, gastrocnemius, geniohyoid, gluteus maximus, gluteus medius, gluteus minimus, gracilis, iliocostalis cervicis, iliocostalis lumborum, iliocostalis thoracis, illiacus, inferior gemellus, inferior oblique, inferior rectus, infraspinatus, interspinalis, intertransversi, lateral pterygoid, lateral rectus, latissimus dorsi, levator anguli oris, levator labii superioris, levator labii superioris alaeque nasi, levator palpebrae superioris, levator scapulae, long rotators, longissimus capitis, longissimus cervicis, longissimus thoracis, longus capitis, longus colli, lumbricals (in the hand), lumbricals (in the foot), masseter, medial pterygoid, medial rectus, middle scalene, multifidus, mylohyoid, obliquus capitis inferior, obliquus capitis superior, obturator externus, obturator internus, occipitalis, omohyoid, opponens digiti minimi, opponens pollicis, orbicularis oculi, orbicularis oris, palmar interossei, palmaris brevis, palmaris longus, pectineus, pectoralis major, pectoralis minor, peroneus brevis, peroneus longus, peroneus tertius, piriformis, plantar interossei, plantaris, platysma, popliteus, posterior scalene, pronator quadratus, pronator teres, psoas major, quadratus femoris, quadratus plantae, rectus capitis anterior, rectus capitis lateralis, rectus capitis posterior major, rectus capitis posterior minor, rectus femoris, rhomboid major, rhomboid minor, risorius, sartorius, scalenus minimus, semimembranosus, semispinalis capitis, semispinalis cervicis, semispinalis thoracis, semitendinosus, serratus anterior, short rotators, soleus, spinalis capitis, spinalis cervicis, spinalis thoracis, splenius capitis, splenius cervicis, sternocleidomastoid, sternohyoid, sternothyroid, stylohyoid, subclavius, subscapularis, superior gemellus, superior oblique, superior rectus, supinator, supraspinatus, temporalis, tensor fascia lata, teres major, teres minor, thoracis, thyrohyoid, tibialis anterior, tibialis posterior, trapezius, triceps brachii, vastus intermedius, vastus lateralis, vastus medialis, zygomaticus major, and zygomaticus minor and any other suitable skeletal muscle as known in the art.

The virus vector can be delivered to skeletal muscle by any suitable method including without limitation intravenous administration, intra-arterial administration, intraperitoneal administration, isolated limb perfusion (of leg and/or arm; see, e.g. Arruda et al., (2005) *Blood* 105:3458-3464), and/or direct intramuscular injection.

Administration to cardiac muscle includes without limitation administration to the left atrium, right atrium, left ventricle, right ventricle and/or septum. The virus vector can be delivered to cardiac muscle by any method known in the art including, e.g., intravenous administration, intra-arterial administration such as intra-aortic administration, direct cardiac injection (e.g., into left atrium, right atrium, left ventricle, right ventricle), and/or coronary artery perfusion.

Administration to diaphragm muscle can be by any suitable method including intravenous administration, intra-arterial administration, and/or intra-peritoneal administration.

Delivery to any of these tissues can also be achieved by delivering a depot comprising the virus vector, which can be implanted into the skeletal, cardiac and/or diaphragm muscle tissue or the tissue can be contacted with a film or other matrix comprising the virus vector. Examples of such implantable matrices or substrates are described in U.S. Pat. No. 7,201,898).

In particular embodiments, a virus vector according to the present invention is administered to skeletal muscle, diaphragm muscle and/or cardiac muscle (e.g., to treat muscular dystrophy or heart disease [for example, PAD or congestive heart failure]).

The invention can be used to treat disorders of skeletal, cardiac and/or diaphragm muscle. Alternatively, the invention can be practiced to deliver a nucleic acid to skeletal, cardiac and/or diaphragm muscle, which is used as a platform for production of a protein product (e.g., an enzyme) or non-translated RNA (e.g., RNAi, microRNA, antisense RNA) that normally circulates in the blood or for systemic delivery to other tissues to treat a disorder (e.g., a metabolic disorder, such as diabetes (e.g., insulin), hemophilia (e.g., Factor IX or Factor VIII), or a lysosomal storage disorder (such as Gaucher's disease [glucocerebrosidase], Pompe disease [lysosomal acid α-glucosidase] or Fabry disease [α-galactosidase A]) or a glycogen storage disorder (such as Pompe disease [lysosomal acid α glucosidase]). Other suitable proteins for treating metabolic disorders are described above.

In a representative embodiment, the invention provides a method of treating muscular dystrophy in a subject in need thereof, the method comprising: administering an effective amount of a virus vector of the invention to a mammalian subject, wherein the virus vector comprises a heterologous nucleic acid effective to treat muscular dystrophy. In an exemplary embodiment, the method comprises: administering an effective amount of a virus vector of the invention to a mammalian subject, wherein the virus vector comprises a heterologous nucleic acid encoding dystrophin, a mini-dystrophin, a micro-dystrophin, utrophin, mini-utrophin, laminin-α2, mini-agrin, Fukutin-related protein, follistatin, dominant negative myostatin, α-sarcoglycan, β-sarcoglycan, γ-sarcoglycan, δ-sarcoglycan, IGF-1, myostatin propeptide, activin type II soluble receptor, anti-inflammatory polypeptides such as the Ikappa B dominant mutant, sarcospan, antibodies or antibody fragments against myostatin or myostatin propeptide, or an inhibitory RNA (e.g., antisense RNA, microRNA or RNAi) against myostatin, mir-1, mir-133, mir-206, mir-208 or an inhibitory RNA (e.g., microRNA, RNAi or antisense RNA) to induce exon skipping in a defective dystrophin gene. In particular embodiments, the virus vector can be administered to skeletal, diaphragm and/or cardiac muscle as described elsewhere herein.

The invention further encompasses a method of treating a metabolic disorder in a subject in need thereof. In representative embodiments, the method comprises: administering an effective amount of a virus vector of the invention to skeletal muscle of a subject, wherein the virus vector comprises a heterologous nucleic acid encoding a polypeptide, wherein the metabolic disorder is a result of a deficiency and/or defect in the polypeptide. Illustrative metabolic disorders and heterologous nucleic acids encoding polypeptides are described herein. As a further option, the heterologous nucleic acid can encode a secreted protein.

The invention can also be practiced to produce inhibitory RNA (e.g., antisense RNA, microRNA or RNAi) for systemic delivery.

The invention also provides a method of treating congenital heart failure in a subject in need thereof, the method comprising administering an effective amount of a virus vector of the invention to a mammalian subject, wherein the virus vector comprises a heterologous nucleic acid effective to treat congenital heart failure. In representative embodiments, the method comprises administering an effective amount of a virus vector of the invention to a mammalian subject, wherein the virus vector comprises a heterologous nucleic acid encoding a sarcoplasmic endoreticulum $Ca^{2+}$-ATPase (SERCA2a), an angiogenic factor, phospholamban, PI3 kinase, calsarcan, a β-adrenergic receptor kinase (βARK), βARKct, inhibitor 1 of protein phosphatase 1, Pim-1, PGC-1α, SOD-1, SOD-2, EC-SOD, Kallikrein, HIF, thymosin-β4, S100A1, parvalbumin, adenylyl cyclase type 6, a molecule that effects G-protein coupled receptor kinase type 2 knockdown such as a truncated constitutively active bARKct; phospholamban inhibitory or dominant-negative molecules such as phospholamban S16E, mir-1, mir-133, mir-206, mir-208.

Injectables can be prepared in conventional forms, either as liquid solutions or suspensions, solid forms suitable for solution or suspension in liquid prior to injection, or as emulsions. Alternatively, one may administer the virus vector in a local rather than systemic manner, for example, in a depot or sustained-release formulation. Further, the virus vector can be delivered dried to a surgically implantable matrix such as a bone graft substitute, a suture, a stent, and the like (e.g., as described in U.S. Pat. No. 7,201,898).

Pharmaceutical compositions suitable for oral administration can be presented in discrete units, such as capsules, cachets, lozenges, or tablets, each containing a predetermined amount of the composition of this invention; as a powder or granules; as a solution or a suspension in an aqueous or non-aqueous liquid; or as an oil-in-water or water-in-oil emulsion. Oral delivery can be performed by complexing a virus vector of the present invention to a carrier capable of withstanding degradation by digestive enzymes in the gut of an animal. Examples of such carriers include plastic capsules or tablets, as known in the art. Such formulations are prepared by any suitable method of pharmacy, which includes the step of bringing into association the composition and a suitable carrier (which may contain one or more accessory ingredients as noted above). In general, the pharmaceutical composition according to embodiments of the present invention are prepared by uniformly and intimately admixing the composition with a liquid or finely divided solid carrier, or both, and then, if necessary, shaping the resulting mixture. For example, a tablet can be prepared by compressing or molding a powder or granules containing the composition, optionally with one or more accessory ingredients. Compressed tablets are prepared by compressing, in a suitable machine, the composition in a free-flowing form, such as a powder or granules optionally mixed with a binder, lubricant, inert diluent, and/or surface active/dispersing agent(s). Molded tablets are made by molding, in a suitable machine, the powdered compound moistened with an inert liquid binder.

Pharmaceutical compositions suitable for buccal (sublingual) administration include lozenges comprising the composition of this invention in a flavored base, usually sucrose and acacia or tragacanth; and pastilles comprising the composition in an inert base such as gelatin and glycerin or sucrose and acacia.

Pharmaceutical compositions suitable for parenteral administration can comprise sterile aqueous and non-aqueous injection solutions of the composition of this invention, which preparations are optionally isotonic with the blood of the intended recipient. These preparations can contain antioxidants, buffers, bacteriostats and solutes, which render the composition isotonic with the blood of the intended recipient. Aqueous and non-aqueous sterile suspensions, solutions and emulsions can include suspending agents and thickening agents. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, and inert gases and the like.

The compositions can be presented in unit/dose or multi-dose containers, for example, in sealed ampoules and vials, and can be stored in a freeze-dried (lyophilized) condition requiring only the addition of the sterile liquid carrier, for example, saline or water-for-injection immediately prior to use.

Extemporaneous injection solutions and suspensions can be prepared from sterile powders, granules and tablets of the kind previously described. For example, an injectable, stable, sterile composition of this invention in a unit dosage form in a sealed container can be provided. The composition can be provided in the form of a lyophilizate, which can be reconstituted with a suitable pharmaceutically acceptable carrier to form a liquid composition suitable for injection into a subject. The unit dosage form can be from about 1 µg to about 10 grams of the composition of this invention. When the composition is substantially water-insoluble, a sufficient amount of emulsifying agent, which is physiologically acceptable, can be included in sufficient quantity to emulsify the composition in an aqueous carrier. One such useful emulsifying agent is phosphatidyl choline.

Pharmaceutical compositions suitable for rectal administration can be presented as unit dose suppositories. These can be prepared by admixing the composition with one or more conventional solid carriers, such as for example, cocoa butter and then shaping the resulting mixture.

Pharmaceutical compositions of this invention suitable for topical application to the skin can take the form of an ointment, cream, lotion, paste, gel, spray, aerosol, or oil. Carriers that can be used include, but are not limited to, petroleum jelly, lanoline, polyethylene glycols, alcohols, transdermal enhancers, and combinations of two or more thereof. In some embodiments, for example, topical delivery can be performed by mixing a pharmaceutical composition of the present invention with a lipophilic reagent (e.g., DMSO) that is capable of passing into the skin.

Pharmaceutical compositions suitable for transdermal administration can be in the form of discrete patches adapted to remain in intimate contact with the epidermis of the subject for a prolonged period of time. Compositions suitable for transdermal administration can also be delivered by iontophoresis (see, for example, *Pharm. Res.* 3:318 (1986)) and typically take the form of an optionally buffered aqueous solution of the composition of this invention. Suitable formulations can comprise citrate or bis\tris buffer (pH 6) or ethanol/water and can contain from 0.1 to 0.2M active ingredient.

The virus vectors disclosed herein may be administered to the lungs of a subject by any suitable means, for example, by administering an aerosol suspension of respirable particles comprised of the virus vectors, which the subject inhales. The respirable particles may be liquid or solid. Aerosols of liquid particles comprising the virus vectors may be produced by any suitable means, such as with a pressure-driven aerosol nebulizer or an ultrasonic nebulizer, as is known to those of skill in the art. See, e.g., U.S. Pat. No. 4,501,729. Aerosols of solid particles comprising the virus vectors may likewise be produced with any solid particulate medicament aerosol generator, by techniques known in the pharmaceutical art.

IV. Use of the AAV Capsid to Target Peripheral Tissues

The AAV capsids and vectors of the present invention have been demonstrated to be fully or nearly fully detargeted for peripheral organs and tissues. This detargeting makes the vectors ideal as a "blank" vector that can be altered to produce the desired tropic profile, e.g., to target specific organs and tissues and/or detarget other organs and tissues. Thus, one aspect of the invention relates to a method of preparing an AAV capsid having a tropism profile of interest, the method comprising modifying the AAV capsid of the present invention to insert an amino acid sequence providing the tropism profile of interest. In some embodiments, the tropism profile of interest is enhanced selectivity for a tissue selected from skeletal muscle, cardiac muscle, diaphragm, kidney, liver, pancreas, spleen, gastrointestinal tract, lung, joint tissue, tongue, ovary, testis, a germ cell, a cancer cell, or a combination thereof and/or reduced selectivity for a tissue selected from liver, ovary, testis, a germ cell, or a combination thereof.

Examples of specific targeting and detargeting sequences are known in the art. One example is the molecular basis for preferential liver tropism, which has been mapped, in the case of AAV2 and AAV6, to a continuous basic footprint that appears to be involved in the interaction of either serotype with heparin. Specifically, it has previously been demonstrated that a single lysine residue on AAV6 (K531) dictates heparin binding ability and consequently, liver tropism. In corollary, substitutional mutagenesis of the corresponding glutamate/aspartate residue on other serotypes with a lysine residue confers heparin binding, possibly by forming a minimum continuous basic footprint on the capsid surface. Another example is the capsid mutants comprising alterations in the three-fold axis loop 4 as disclosed in International Publication No. WO 2012/093784, incorporated herein by reference in its entirety. These mutants exhibit one or more properties including (i) reduced transduction of liver, (ii) enhanced movement across endothelial cells, (iii) systemic transduction; (iv) enhanced transduction of muscle tissue (e.g., skeletal muscle, cardiac muscle and/or diaphragm muscle), and/or (v) reduced transduction of brain tissues (e.g., neurons). Other tropic sequences are described in Li et al., (2012) J. Virol. 86:7752-7759; Pulicherla et al., (2011) Mol. Ther. 19:1070-1078; Bowles et al., (2012) Mol. Ther. 20:443-455; Asokan et al., (2012) Mol. Ther. 20:699-708; and Asokan et al., (2010) Nature Biotechnol. 28:79-82; each incorporated by reference in its entirety.

In some embodiments, the AAV capsid of the present invention can be modified through DNA scrambling and/or directed evolution to identify modified capsids having the desired tropism profile. Techniques for DNA scrambling and directed evolution of AAV capsids are described in International Publication No. WO 2009/137006, incorporated herein by reference in its entirety.

V. Chimeric AAV Capsids Targeted to Oligodendrocytes

The inventors have identified chimeric AAV capsid structures capable of preferentially transducing oligodendrocytes over neurons and other cells of the CNS. Thus, one aspect of the invention relates to a nucleic acid encoding an AAV capsid, the nucleic acid comprising, consisting essentially of, or consisting of the VP1, VP2, or VP1/VP2 encoding portion of an AAV capsid coding sequence that is at least 90% identical to: (a) the nucleotide sequence of SEQ ID NO:129 (BNP61); or (b) a nucleotide sequence encoding SEQ ID NO:130 (BNP61); operably linked to the VP3 portion of a different AAV capsid coding sequence; and viruses comprising the chimeric AAV capsids. In some embodiments, the VP1, VP2, or VP1/VP2 portion of the AAV capsid coding sequence is at least 91%, 92%, 93%, 94%, 95%, 96%, 97%, 98% or 99% identical to the VP1, VP2, or VP1/VP2 encoding portion of the nucleotide sequence of (a) or (b). In another embodiment, the AAV capsid coding sequence comprises, consists essentially of, or consists of the VP1, VP2, or VP1/VP2 encoding portion of the nucleotide sequence of (a) or (b). In some embodiments, the VP3 encoding portion of a different AAV capsid coding sequence is a wild-type capsid sequence (e.g., AAV8 or AAV9) or a chimeric sequence that is different from any of the capsid sequences of the present invention.

In certain embodiments, the nucleic acid of the invention further encodes an E532K substitution in the capsid protein (numbering relative to the AAV8 capsid sequence).

In some embodiments, the nucleic acid encoding an AAV capsid comprises, consists essentially of, or consists of the VP1, VP2, or VP1/VP2 encoding portion of an AAV capsid coding sequence that is at least 90% identical to a nucleotide sequence encoding SEQ ID NOS:131 (BNP62) or 132 (BNP63) operably linked to the VP3 encoding portion of a different AAV capsid sequence; and viruses comprising the chimeric AAV capsids. In some embodiments, the VP1, VP2, or VP1/VP2 encoding portion of the AAV capsid coding sequence is at least 91%, 92%, 93%, 94%, 95%, 96%, 97%, 98% or 99% identical to the VP1, VP2, or VP1/VP2 encoding portion of the nucleotide sequence encoding SEQ ID NOS:131 or 132. In another embodiment, the AAV capsid coding sequence comprises, consists essentially of, or consists of the VP1, VP2, or VP1/VP2 encoding portion of the nucleotide sequence encoding SEQ ID NOS: 131 or 132 operably linked to the VP3 portion of a different AAV capsid coding sequence. In some embodiments, the VP3 encoding portion of a different AAV capsid coding sequence is a wild-type capsid sequence (e.g., AAV8 or AAV9) or a chimeric sequence that is different from any of the capsid sequences of the present invention.

In certain embodiments, the nucleic acid of the invention further encodes an E532K substitution in the capsid protein (numbering relative to the AAV8 capsid sequence).

SEQ ID NOS:130-132 show examples of the VP1 capsid protein sequences of the invention. The designation of all amino acid positions in the description of the invention and the appended claims is with respect to VP1 numbering. Those skilled in the art will understand that the AAV capsid generally contains the smaller VP2 and VP3 capsid proteins as well. Due to the overlap of the coding sequences for the AAV capsid proteins, the nucleic acid coding sequences and amino acid sequences of the VP2 and VP3 capsid proteins will be apparent from the VP1 sequences shown in SEQ ID NOS:129-132. In particular, VP2 starts at nucleotide 412 (acg) of SEQ ID NO:129 and threonine 148 of SEQ ID NO:130. VP3 starts at nucleotide 607 (atg) of SEQ ID NO:129 and methionine 203 of SEQ ID NO:130. In certain embodiments, isolated VP2 and VP3 capsid proteins comprising the sequence from SEQ ID NOS:130-132 and isolated nucleic acids encoding the VP2 or VP3 proteins, or both, are contemplated.

In certain embodiments, the capsid of the invention further comprises an E532K substitution (numbering relative to the AAV8 capsid sequence).

The invention also provides chimeric AAV capsid proteins and chimeric capsids, wherein the capsid protein comprises, consists essentially of, or consists of an amino acid sequence as shown in one of SEQ ID NOS:130-132, wherein 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer of the amino acids within the capsid protein coding sequence of one of SEQ ID NOS: 130-132 is substituted by another amino acid (naturally occurring, modified and/or synthetic), optionally a conservative amino acid substitution, and/or are deleted and/or there are insertions (including N-terminal and C-terminal extensions) of 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer amino acids or any combination of substitutions, deletions and/or insertions, wherein the substitutions, deletions and/or insertions do not unduly impair the structure and/or function of a virion (e.g., an AAV virion) comprising the variant capsid protein or capsid. For example, in representative embodiments of the invention, an AAV virion comprising the chimeric capsid protein substantially retains at least one property of a chimeric virion comprising a chimeric capsid protein as shown in one of SEQ ID NOS:130-132, For example, the virion comprising the chimeric capsid protein can substantially retain the oligodendrocyte tropism profile of a virion comprising the chimeric AAV capsid protein as shown in one of SEQ ID NOS:130-132. Methods of evaluating biological properties such as virus transduction are well-known in the art (see, e.g., the Examples).

A further embodiment of the invention relates to a nucleic acid encoding an AAV8 capsid, the capsid comprising an E532K substitution. In some embodiments, the nucleic acid comprises, consists essentially of, or consists of an AAV capsid coding sequence that is at least 90% identical to: (a) the nucleotide sequence of SEQ ID NO:133 (AAV8 E532K capsid nucleotide sequence); or (b) a nucleotide sequence encoding SEQ ID NO:134 (AAV8 E532K capsid amino acid sequence); and viruses comprising the chimeric AAV capsids. In some embodiments, the AAV capsid coding sequence is at least 91%, 92%, 93%, 94%, 95%, 96%, 97%, 98% or 99% identical to the nucleotide sequence of (a) or (b). In another embodiment, the AAV capsid coding sequence comprises, consists essentially of, or consists of the nucleotide sequence of (α) or (b). In some embodiments, the AAV8 E532K capsid coding sequence further comprises the VP1, VP2, or VP1/VP2 encoding portions of the capsids sequences of the invention.

Conservative amino acid substitutions are known in the art. In particular embodiments, a conservative amino acid substitution includes substitutions within one or more of the following groups: glycine, alanine; valine, isoleucine, leucine; aspartic acid, glutamic acid; asparagine, glutamine; serine, threonine; lysine, arginine; and/or phenylalanine, tyrosine.

It will be apparent to those skilled in the art that the amino acid sequences of the chimeric AAV capsid protein of SEQ ID NOS:130-132 and/or the AAV8 E532K substitution can further be modified to incorporate other modifications as known in the art to impart desired properties. As nonlimiting possibilities, the capsid protein can be modified to incorporate targeting sequences (e.g., RGD) or sequences that facilitate purification and/or detection. For example, the capsid protein can be fused to all or a portion of glutathione-S-transferase, maltose-binding protein, a heparin/heparan sulfate binding domain, poly-His, a ligand, and/or a reporter protein (e.g., Green Fluorescent Protein, β-glucuronidase, β-galactosidase, luciferase, etc.), an immunoglobulin Fc fragment, a single-chain antibody, hemagglutinin, c-myc, FLAG epitope, and the like to form a fusion protein. Methods of inserting targeting peptides into the AAV capsid are known in the art (see, e.g., international patent publication WO 00/28004; Nicklin et al., (2001) *Mol. Ther.* 474-181; White et al., (2004) *Circulation* 109:513-319; Muller et al., (2003) *Nature Biotech.* 21:1040-1046.

The viruses of the invention can further comprise a duplexed viral genome as described in international patent publication WO 01/92551 and U.S. Pat. No. 7,465,583.

The invention also provides AAV capsids comprising the chimeric AAV capsid proteins of the invention and virus particles (i.e., virions) comprising the same, wherein the virus particle packages (i.e., encapsidates) a vector genome, optionally an AAV vector genome. In particular embodiments, the invention provides an AAV particle comprising an AAV capsid comprising an AAV capsid protein of the invention, wherein the AAV capsid packages an AAV vector genome. The invention also provides an AAV particle comprising an AAV capsid or AAV capsid protein encoded by the chimeric nucleic acid capsid coding sequences of the invention.

In particular embodiments, the virion is a recombinant vector comprising a heterologous nucleic acid of interest, e.g., for delivery to a cell. Thus, the present invention is useful for the delivery of nucleic acids to cells in vitro, ex vivo, and in vivo. In representative embodiments, the recombinant vector of the invention can be advantageously employed to deliver or transfer nucleic acids to animal (e.g., mammalian) cells.

Any heterologous nucleotide sequence(s) may be delivered by a virus vector of the present invention. Nucleic acids of interest include nucleic acids encoding polypeptides, optionally therapeutic (e.g., for medical or veterinary uses) and/or immunogenic (e.g., for vaccines) polypeptides.

In some embodiments, the polypeptide is one that stimulates growth and/or differentiation of oligodendrocytes. Examples include, without limitation, insulin-like growth factor-1, glial-derived neurotrophic factor, neurotrophin-3, artemin, transforming growth factor alpha, platelet-derived growth factor, leukemia inhibitory factor, prolactin, monocarboxylate transporter 1, or nuclear factor 1A.

Therapeutic polypeptides include, but are not limited to, those described above.

Heterologous nucleotide sequences encoding polypeptides include those encoding reporter polypeptides as described above.

Alternatively, the heterologous nucleic acid may encode an antisense oligonucleotide, a ribozyme, RNAs that effect spliceosome-mediated trans-splicing, interfering RNAs (RNAi) including small interfering RNAs (siRNA) that mediate gene silencing, microRNA, or other non-translated "functional" RNAs, such as "guide" RNAs, and the like as described above.

The present invention also provides recombinant virus vectors that express an immunogenic polypeptide, e.g., for vaccination, as described above.

Alternatively, the heterologous nucleotide sequence may encode any polypeptide that is desirably produced in a cell in vitro, ex vivo, or in vivo. For example, the virus vectors may be introduced into cultured cells and the expressed protein product isolated therefrom.

It will be understood by those skilled in the art that the heterologous nucleic acid(s) of interest may be operably associated with appropriate control sequences as described above. Advantageously, the oligodendrocyte-specific chimeric capsids of the present invention permit the use of constitutive promoters to express the heterologous nucleic acid(s) of interest in an oligodendrocyte-specific manner, as compared to prior art AAV vectors which required the use of oligodendrocyte-specific promoters.

The invention also provides chimeric AAV particles comprising an AAV capsid and an AAV genome, wherein the AAV genome "corresponds to" (i.e., encodes) the AAV capsid. Also provided are collections or libraries of such chimeric AAV particles, wherein the collection or library comprises 2 or more, 10 or more, 50 or more, 100 or more, 1000 or more, $10^4$ or more, $10^5$ or more, or $10^6$ or more distinct sequences.

The present invention further encompasses "empty" capsid particles (i.e., in the absence of a vector genome) comprising, consisting of, or consisting essentially of the chimeric AAV capsid proteins of the invention. The chimeric AAV capsids of the invention can be used as "capsid vehicles," as has been described in U.S. Pat. No. 5,863,541. Molecules that can be covalently linked, bound to or packaged by the virus capsids and transferred into a cell include DNA, RNA, a lipid, a carbohydrate, a polypeptide, a small organic molecule, or combinations of the same. Further, molecules can be associated with (e.g., "tethered to") the outside of the virus capsid for transfer of the molecules into host target cells. In one embodiment of the invention the molecule is covalently linked (i.e., conjugated or chemically coupled) to the capsid proteins. Methods of covalently linking molecules are known by those skilled in the art.

The virus capsids of the invention also find use in raising antibodies against the novel capsid structures. As a further alternative, an exogenous amino acid sequence may be inserted into the virus capsid for antigen presentation to a cell, e.g., for administration to a subject to produce an immune response to the exogenous amino acid sequence.

The invention also provides nucleic acids (e.g., isolated nucleic acids) encoding the chimeric virus capsids and chimeric capsid proteins of the invention. Further provided are vectors comprising the nucleic acids, and cells (in vivo or in culture) comprising the nucleic acids and/or vectors of the invention. Such nucleic acids, vectors and cells can be used, for example, as reagents (e.g., helper constructs or packaging cells) for the production of virus vectors as described herein.

In exemplary embodiments, the invention provides nucleic acid sequences encoding the AAV capsid of SEQ ID NOS:130-132 or at least 90% identical to the nucleotide sequence of SEQ ID NO:129. The invention also provides nucleic acids encoding the AAV capsid variants, capsid protein variants and fusion proteins as described above. In particular embodiments, the nucleic acid hybridizes to the complement of the nucleic acid sequences specifically disclosed herein under standard conditions as known by those skilled in the art and encodes a variant capsid and/or capsid protein. Optionally, the variant capsid or capsid protein substantially retains at least one property of the capsid and/or capsid or capsid protein encoded by the nucleic acid sequence of SEQ ID NO:129. For example, a virus particle comprising the variant capsid or variant capsid protein can substantially retain the oligodendrocyte tropism profile of a virus particle comprising a capsid or capsid protein encoded by a nucleic acid coding sequence of SEQ ID NO:129.

For example, hybridization of such sequences may be carried out under conditions of reduced stringency, medium stringency or even stringent conditions as described above.

In other embodiments, nucleic acid sequences encoding a variant capsid or capsid protein of the invention have at least about 90%, 91%, 92%, 93%, 94%, 95%, 96%, 97%, 98%, 99%, or higher sequence identity with the nucleic acid sequence of SEQ ID NO:129 and optionally encode a variant capsid or capsid protein that substantially retains at least one property of the capsid or capsid protein encoded by a nucleic acid of SEQ ID NO:129.

As is known in the art, a number of different programs can be used to identify whether a nucleic acid or polypeptide has sequence identity to a known sequence as described above.

In particular embodiments, the nucleic acid can comprise, consist essentially of, or consist of a vector including but not limited to a plasmid, phage, viral vector (e.g., AAV vector, an adenovirus vector, a herpesvirus vector, or a baculovirus vector), bacterial artificial chromosome (BAC), or yeast artificial chromosome (YAC). For example, the nucleic acid can comprise, consist of, or consist essentially of an AAV vector comprising a 5' and/or 3' terminal repeat (e.g., 5' and/or 3' AAV terminal repeat).

In some embodiments, the nucleic acid encoding the chimeric AAV capsid protein further comprises an AAV rep coding sequence. For example, the nucleic acid can be a helper construct for producing viral stocks.

The invention also provides packaging cells stably comprising a nucleic acid of the invention as described above.

The nucleic acid can be incorporated into a delivery vector, such as a viral delivery vector. To illustrate, the nucleic acid of the invention can be packaged in an AAV particle, an adenovirus particle, a herpesvirus particle, a baculovirus particle, or any other suitable virus particle.

Moreover, the nucleic acid can be operably associated with a promoter element. Promoter elements are described in more detail herein.

The present invention further provides methods of producing the virus vectors of the invention as described above.

The inventive packaging methods may be employed to produce high titer stocks of virus particles. In particular embodiments, the virus stock has a titer of at least about $10^5$ transducing units (tu)/ml, at least about $10^6$ tu/ml, at least about $10^7$ tu/ml, at least about $10^8$ tu/ml, at least about $10^9$ tu/ml, or at least about $10^{10}$ tu/ml.

The novel capsid protein and capsid structures find use in raising antibodies, for example, for diagnostic or therapeutic uses or as a research reagent. Thus, the invention also provides antibodies against the novel capsid proteins and capsids of the invention as described above.

VI. Methods of Using Chimeric AAV Capsids Targeted to Oligodendrocytes

The present invention also relates to methods for delivering heterologous nucleotide sequences into oligodendrocytes. The virus vectors of the invention may be employed, e.g., to deliver a nucleotide sequence of interest to an oligodendrocyte in vitro, e.g., to produce a polypeptide or nucleic acid in vitro or for ex vivo gene therapy. The vectors are additionally useful in a method of delivering a nucleotide sequence to a subject in need thereof, e.g., to express a therapeutic or immunogenic polypeptide or nucleic acid. In this manner, the polypeptide or nucleic acid may thus be produced in vivo in the subject. The subject may be in need of the polypeptide or nucleic acid because the subject has a deficiency of the polypeptide, or because the production of the polypeptide or nucleic acid in the subject may impart some therapeutic effect, as a method of treatment or otherwise, and as explained further below.

In particular embodiments, the vectors are useful to express a polypeptide or nucleic acid that provides a beneficial effect to oligodendrocytes, e.g., to promote growth and/or differentiation of oligodendrocytes. The ability to target vectors to oligodendrocytes may be particularly useful to treat diseases or disorders involving oligodendrocyte dysfunction and/or demyelination of neurons. In other embodiments, the vectors are useful to express a polypeptide or nucleic acid that provides a beneficial effect to cells near the oligodendrocytes (e.g., neurons).

Thus, one aspect of the invention relates to a method of delivering a nucleic acid of interest to an oligodendrocyte, the method comprising contacting the oligodendrocyte with the AAV particle of the invention.

In another aspect, the invention relates to a method of delivering a nucleic acid of interest to an oligodendrocyte in a mammalian subject, the method comprising administering an effective amount of the AAV particle or pharmaceutical formulation of the invention to a mammalian subject.

A further aspect of the invention relates to a method of treating a disorder associated with oligodendrocyte dysfunction in a subject in need thereof, the method comprising administering a therapeutically effective amount of the AAV particle of the invention to the subject. In one embodiment, the disorder associated with oligodendrocyte dysfunction is a demyelinating disease. In one embodiment, the disorder associated with oligodendrocyte dysfunction is multiple sclerosis, Pelizaeus-Merzbacher disease, Krabbe's disease, metachromatic leukodystrophy, adrenoleukodystrophy, Canavan disease, Alexander disease, orthochromatic leukodystrophy, Zellweger disease, 18q-syndrome, cerebral palsy, spinal cord injury, traumatic brain injury, stroke, phenylketonuria, or viral infection, or any other disorder known or later found to be associated with oligodendrocyte dysfunction. In another embodiment, the methods of the invention are used to treat a disorder that is not directly associated with oligodendrocyte dysfunction but would benefit by expression of a heterologous polypeptide or nucleic acid in oligodendrocytes in addition to or instead of expression in neurons, astrocytes, or other CNS cell types. Examples include, without limitation, neurodegenerative disorders such as Alzheimer's disease, Parkinson's disease, and Huntington's disease, CNS tumors, and other CNS disorders as described above.

In another aspect of the invention, the chimeric AAV capsid and vectors of the invention are fully- or nearly fully-detargeted vectors that can be further modified to a desirable tropic profile for targeting of one or more peripheral organs or tissues as described above. In this aspect, the present invention also relates to methods for delivering heterologous nucleotide sequences into a broad range of cells, including dividing and non-dividing cells. The virus vectors of the invention may be employed to deliver a nucleotide sequence of interest to a cell in vitro, e.g., to produce a polypeptide in vitro or for ex vivo gene therapy. The vectors are additionally useful in a method of delivering a nucleotide sequence to a subject in need thereof, e.g., to express a therapeutic or immunogenic polypeptide or nucleic acid. In this manner, the polypeptide or nucleic acid may thus be produced in vivo in the subject. The subject may be in need of the polypeptide or nucleic acid because the subject has a deficiency of the polypeptide, or because the production of the polypeptide or nucleic acid in the subject may impart some therapeutic effect, as a method of treatment or otherwise, and as explained further below.

In general, the virus vectors of the invention may be employed to deliver any foreign nucleic acid with a biological effect to treat or ameliorate the symptoms associated with any disorder related to gene expression. Further, the invention can be used to treat any disease state for which it is beneficial to deliver a therapeutic polypeptide. Illustrative disease states include those described above.

The virus vectors according to the present invention may also be employed to provide an antisense nucleic acid or inhibitory RNA (e.g., microRNA or RNAi such as a siRNA or shRNA) to a cell in vitro or in vivo. Expression of the inhibitory RNA in the target cell diminishes expression of a particular protein(s) by the cell. Accordingly, inhibitory RNA may be administered to decrease expression of a particular protein in a subject in need thereof. Inhibitory RNA may also be administered to cells in vitro to regulate cell physiology, e.g., to optimize cell or tissue culture systems.

As a further aspect, the virus vectors of the present invention may be used to produce an immune response in a subject. According to this embodiment, a virus vector comprising a nucleic acid encoding an immunogen may be administered to a subject, and an active immune response (optionally, a protective immune response) is mounted by the subject against the immunogen. Immunogens are as described hereinabove.

Alternatively, the virus vector may be administered to a cell ex vivo and the altered cell is administered to the subject. The heterologous nucleic acid is introduced into the cell, and the cell is administered to the subject, where the heterologous nucleic acid encoding the immunogen is optionally expressed and induces an immune response in the subject against the immunogen. In particular embodiments, the cell is an antigen-presenting cell (e.g., a dendritic cell).

The virus vectors of the present invention may also be administered for cancer immunotherapy by administration of a viral vector expressing a cancer cell antigen (or an immunologically similar molecule) or any other immunogen that produces an immune response against a cancer cell as described above. The virus vector may be administered to a subject in vivo or by using ex vivo methods, as described herein.

In particular embodiments, cells may be removed from a subject with cancer and contacted with a virus vector according to the present invention. The modified cell is then administered to the subject, whereby an immune response against the cancer cell antigen is elicited. This method is particularly advantageously employed with immunocompromised subjects that cannot mount a sufficient immune response in vivo (i.e., cannot produce enhancing antibodies in sufficient quantities).

It is known in the art that immune responses may be enhanced by immunomodulatory cytokines (e.g., α-interferon, β-interferon, γ-interferon, ω-interferon, τ-interferon, interleukin-1α, interleukin-1β, interleukin-2, interleukin-3, interleukin-4, interleukin 5, interleukin-6, interleukin-7, interleukin-8, interleukin-9, interleukin-10, interleukin-11, interleukin 12, interleukin-13, interleukin-14, interleukin-18, B cell Growth factor, CD40 Ligand, tumor necrosis factor-a, tumor necrosis factor-β, monocyte chemoattractant protein-1, granulocyte-macrophage colony stimulating factor, and lymphotoxin). Accordingly, immunomodulatory cytokines (e.g., CTL inductive cytokines) may be administered to a subject in conjunction with the virus vectors.

Cytokines may be administered by any method known in the art. Exogenous cytokines may be administered to the subject, or alternatively, a nucleotide sequence encoding a cytokine may be delivered to the subject using a suitable vector, and the cytokine produced in vivo.

The viral vectors are further useful for targeting oligodendrocytes for research purposes, e.g., for study of CNS function in vitro or in animals or for use in creating and/or studying animal models of disease. For example, the vectors can be used to deliver heterologous nucleic acids to oligodendrocytes in animal models of demyelinating diseases. Demyelination can be induced in animals by a variety of means, including without limitation administration of viruses (e.g., Semliki virus, murine hepatitis virus, or Theiler's murine encephalomyelitis virus) and administration of chemicals (e.g., cuprizone, ethidium bromide, or lysolecithin). In some embodiments, the vector can also be used in animal models of experimental autoimmune encephalomyelitis. This condition can be induced by, for example, administration of kainite, SIN-1, anti-galactocerebroside, or irradiation. In other embodiments, the viral vector can be used to specifically deliver to oligodendrocytes a toxic agent or an enzyme that produces a toxic agent (e.g., thymidine kinase) in order to kill some or all of the cells.

Further, the virus vectors according to the present invention find further use in diagnostic and screening methods, whereby a gene of interest is transiently or stably expressed in a cell culture system, or alternatively, a transgenic animal model. The invention can also be practiced to deliver a nucleic acid for the purposes of protein production, e.g., for laboratory, industrial or commercial purposes.

Recombinant virus vectors according to the present invention find use in both veterinary and medical applications. Suitable subjects include both avians and mammals as described above. Optionally, the subject is "in need of" the methods of the present invention, e.g., because the subject has or is believed at risk for a disorder including those described herein or that would benefit from the delivery of a nucleic acid including those described herein. For example, in particular embodiments, the subject has (or has had) or is at risk for a demyelinating disorder or a spinal cord or brain injury. As a further option, the subject can be a laboratory animal and/or an animal model of disease.

In particular embodiments, the present invention provides a pharmaceutical composition comprising a virus vector of the invention in a pharmaceutically acceptable carrier and, optionally, other medicinal agents, pharmaceutical agents, stabilizing agents, buffers, carriers, adjuvants, diluents, etc. For injection, the carrier will typically be a liquid. For other methods of administration, the carrier may be either solid or liquid. For inhalation administration, the carrier will be respirable, and will preferably be in solid or liquid particulate form.

By "pharmaceutically acceptable" it is meant a material that is not toxic or otherwise undesirable, i.e., the material may be administered to a subject without causing any undesirable biological effects.

One aspect of the present invention is a method of transferring a nucleotide sequence to a cell in vitro. The virus vector may be introduced to the cells at the appropriate multiplicity of infection according to standard transduction methods appropriate for the particular target cells. Titers of the virus vector or capsid to administer can vary, depending upon the target cell type and number, and the particular virus vector or capsid, and can be determined by those of skill in the art without undue experimentation. In particular embodiments, at least about $10^3$ infectious units, more preferably at least about $10^5$ infectious units are introduced to the cell.

The cell(s) into which the virus vector can be introduced may be of any type as described above.

The virus vectors may be introduced to cells in vitro for the purpose of administering the modified cell to a subject. In particular embodiments, the cells have been removed from a subject, the virus vector is introduced therein, and the cells are then replaced back into the subject. Methods of removing cells from subject for treatment ex vivo, followed by introduction back into the subject are known in the art (see, e.g., U.S. Pat. No. 5,399,346). Alternatively, the recombinant virus vector is introduced into cells from another subject, into cultured cells, or into cells from any other suitable source, and the cells are administered to a subject in need thereof.

Suitable cells for ex vivo gene therapy are as described above. Dosages of the cells to administer to a subject will vary upon the age, condition and species of the subject, the type of cell, the nucleic acid being expressed by the cell, the mode of administration, and the like. Typically, at least about $10^2$ to about $10^8$ or about $10^3$ to about $10^6$ cells will be administered per dose in a pharmaceutically acceptable carrier. In particular embodiments, the cells transduced with the virus vector are administered to the subject in an effective amount in combination with a pharmaceutical carrier.

In some embodiments, cells that have been transduced with the virus vector may be administered to elicit an immunogenic response against the delivered polypeptide (e.g., expressed as a transgene or in the capsid) as described above.

A further aspect of the invention is a method of administering the virus vectors or capsids of the invention to subjects. In particular embodiments, the method comprises a method of delivering a nucleic acid of interest to an animal subject, the method comprising: administering an effective amount of a virus vector according to the invention to an animal subject. Administration of the virus vectors of the present invention to a human subject or an animal in need thereof can be by any means known in the art. Optionally, the virus vector is delivered in an effective dose in a pharmaceutically acceptable carrier.

The virus vectors of the invention can further be administered to a subject to elicit an immunogenic response (e.g., as a vaccine) as described above.

Dosages of the virus vectors to be administered to a subject will depend upon the mode of administration, the disease or condition to be treated, the individual subject's condition, the particular virus vector, and the nucleic acid to be delivered, and can be determined in a routine manner. Exemplary doses for achieving therapeutic effects are virus titers of at least about $10^5$, $10^6$, $10^7$, $10^8$, $10^9$, $10^{10}$, $10^{11}$, $10^{12}$, $10^3$, $10^{14}$, $10^{15}$ transducing units or more, preferably about $10^7$ or $10^8$, $10^9$, $10^{10}$, $10^{11}$, $10^{12}$, $10^{13}$ or $10^{14}$ transducing units, yet more preferably about $10^{12}$ transducing units.

In particular embodiments, more than one administration (e.g., two, three, four or more administrations) may be employed to achieve the desired level of gene expression over a period of various intervals, e.g., daily, weekly, monthly, yearly, etc.

Exemplary modes of administration include oral, rectal, transmucosal, topical, intranasal, inhalation (e.g., via an aerosol), buccal (e.g., sublingual), vaginal, intrathecal, intraocular, transdermal, in utero (or in ovo), parenteral (e.g., intravenous, subcutaneous, intradermal, intramuscular [including administration to skeletal, diaphragm and/or cardiac muscle], intradermal, intrapleural, intracerebral, and intraarticular), topical (e.g., to both skin and mucosal surfaces, including airway surfaces, and transdermal administration), intro-lymphatic, and the like, as well as direct tissue or organ injection (e.g., to liver, skeletal muscle, cardiac muscle, diaphragm muscle or brain). Administration can also be to a tumor (e.g., in or near a tumor or a lymph node). The most suitable route in any given case will depend on the nature and severity of the condition being treated and on the nature of the particular vector that is being used.

In some embodiments, the viral vector is administered directly to the CNS, e.g., the brain or the spinal cord. Direct administration can result in high specificity of transduction of oligodendrocytes, e.g., wherein at least 80%, 85%, 90%, 95% or more of the transduced cells are oligodendrocytes. Any method known in the art to administer vectors directly to the CNS can be used. The vector may be introduced into the spinal cord, brainstem (medulla oblongata, pons), midbrain (hypothalamus, thalamus, epithalamus, pituitary gland, substantia nigra, pineal gland), cerebellum, telencephalon (corpus striatum, cerebrum including the occipital, temporal, parietal and frontal lobes, cortex, basal ganglia, hippocampus and amygdala), limbic system, neocortex, corpus striatum, cerebrum, and inferior colliculus. The vector may also be administered to different regions of the eye such as the retina, cornea or optic nerve. The vector may be delivered into the cerebrospinal fluid (e.g., by lumbar puncture) for more disperse administration of the vector.

The delivery vector may be administered to the desired region(s) of the CNS by any route known in the art, including but not limited to, intrathecal, intracerebral, intraventricular, intranasal, intra-aural, intra-ocular (e.g., intra-vitreous, sub-retinal, anterior chamber) and peri-ocular (e.g., sub-Tenon's region) delivery or any combination thereof.

Typically, the viral vector will be administered in a liquid formulation by direct injection (e.g., stereotactic injection) to the desired region or compartment in the CNS. In some embodiments, the vector can be delivered via a reservoir and/or pump. In other embodiments, the vector may be provided by topical application to the desired region or by intra-nasal administration of an aerosol formulation. Administration to the eye or into the ear, may be by topical application of liquid droplets. As a further alternative, the vector may be administered as a solid, slow-release formulation. Controlled release of parvovirus and AAV vectors is described by international patent publication WO 01/91803.

In some embodiments where the subject has a compromised blood-brain barrier (BBB), the viral vector can be delivered systemically (e.g., intravenously) to the subject, wherein the vector transduces oligodendrocytes in the area of (e.g., bordering) the BBB compromise. In certain embodiments, the vector transduces cells in the compromised area but not cells in uncompromised areas. Thus, one aspect of the invention relates to a method of delivering a nucleic acid of interest to an area of the CNS bordering a compromised blood brain barrier area in a mammalian subject, the method comprising intravenously administering an effective amount of the AAV particle of the invention.

In some embodiments, the compromise in the BBB is due to a disease or disorder as described above. In other embodiments, the BBB compromise can be an induced disruption, e.g., to promote delivery of agents to the CNS as described above.

Injectables can be prepared in conventional forms, either as liquid solutions or suspensions, solid forms suitable for solution or suspension in liquid prior to injection, or as emulsions. Alternatively, one may administer the virus vector in a local rather than systemic manner, for example, in a depot or sustained-release formulation. Further, the virus vector can be delivered dried to a surgically implantable matrix such as a bone graft substitute, a suture, a stent, and the like (e.g., as described in U.S. Pat. No. 7,201,898).

Pharmaceutical compositions suitable for different routes of administration can be as described above.

Having described the present invention, the same will be explained in greater detail in the following examples, which are included herein for illustration purposes only, and which are not intended to be limiting to the invention.

Example 1

Development of AAV Capsids with Enhanced CNS Tropism and Minimal Peripheral Organ Tropism The AAV capsids were developed through a process called capsid DNA shuffling and directed evolution, which was used to generate a library of novel AAV capsid sequences. These capsids were then subjected to multiple rounds of selective pressure in mice, with potential additional capsid mutagenesis occurring in between rounds of selection. Recovered capsid clones were used as vectors to a reporter transgene (GFP) or therapeutic transgene (MeCP2 for Rett syndrome) and evaluated in mice for biodistribution and therapeutic potential.

The original library used consisted of shuffled capsids from AAV serotypes 1, 2, 6, 8, 9, and rh10. Additional engineered capsids were also incorporated: AAV2.5, AAV2i8, AAV9.47, Seiz32, Seiz83, and undescribed capsids from Dr. Gray's laboratory (retrograde clones 1 and 114). The library was produced as previously described (Li et al., Mol. Ther. 16:1252-1260 (2008)). Either wildtype mice or mice modelling Rett syndrome (B6.129P2(C)-Mecp2$^{tm1.1Bird}$/J) were used for in vivo selection. For each round of selection, mice (WT mice, knockout male Rett mice, heterozygous female Rett mice) received a single lumbar intrathecal injection of the library, then 2-5 days later tissue was recovered from the cervical spinal cord and multiple regions of the brain. From these samples, the tissue was mechanically dissociated to preferentially recover neurons as described (Li et al., Mol. Ther. 16:1252-1260 (2008)). DNA was recovered from neuron-enriched samples using a DNeasy blood and tissue kit (Qiagen, cat. #69506). Error-prone PCR was employed to further diversify the library between rounds, using taq polymerase with a low starting template and 50 amplification cycles, with primers previously described (Li et al., Mol. Ther. 16:1252-1260 (2008)). The pooled PCR products were cloned back into a WT AAV backbone (pSSV9) and pooled clones were used to generate the next round's starting library. Pooled clones were transfected into HEK293 cells with an adenovirus helper plasmid (pXX680) and a 10-fold excess of pXR2 containing AAV2 Rep and Cap. By this method, chimeric capsids were packaged into mostly AAV2 capsids. Then the AAV2-encapsidated chimeras were added to HEK293 cells at an MOI of 0.5 genomes per cell with WT adenovirus at an MOI of 5 infectious units per cell to predominantly package each chimeric AAV genome in its own capsid. After 72 hours the cells were harvested and the virus purified as described (Grieger et al., Nat. Protoc. 1:1412-28 (2006)) and titered by qPCR. A total of 3 rounds of selection were performed. A sampling of recovered capsids after each round were subcloned into recombinant AAV2 backbones (lacking ITR elements) and SSV9 replication-competent backbones and sequenced.

To evaluate the biodistribution and (in some cases therapeutic potential) of the recovered capsids, some clones were dosed into mice by a single lumbar intrathecal administration in a volume of 5 microliters. When evaluating biodistribution, mice were killed 2-4 weeks post-injection, and tissue samples were analyzed for vector DNA biodistribution as described (Li et al., Mol. Ther. 16:1252-1260 (2008)). When evaluating the therapeutic potential of the recovered capsid clones, the human MeCP2 gene (driven by the mouse MeCP2 promoter) was packaged into each capsid, then dosed into male knockout Rett mice at 4-5 weeks of age by lumbar intrathecal injection. Mice were monitored for the time at which they lost 20% of their peak body weight, which was used as a pre-determined endpoint to indicate survival as previously described (Gadalla et al., *Mol. Ther.* 21(1):18-30 (2013)).

Figure 2:
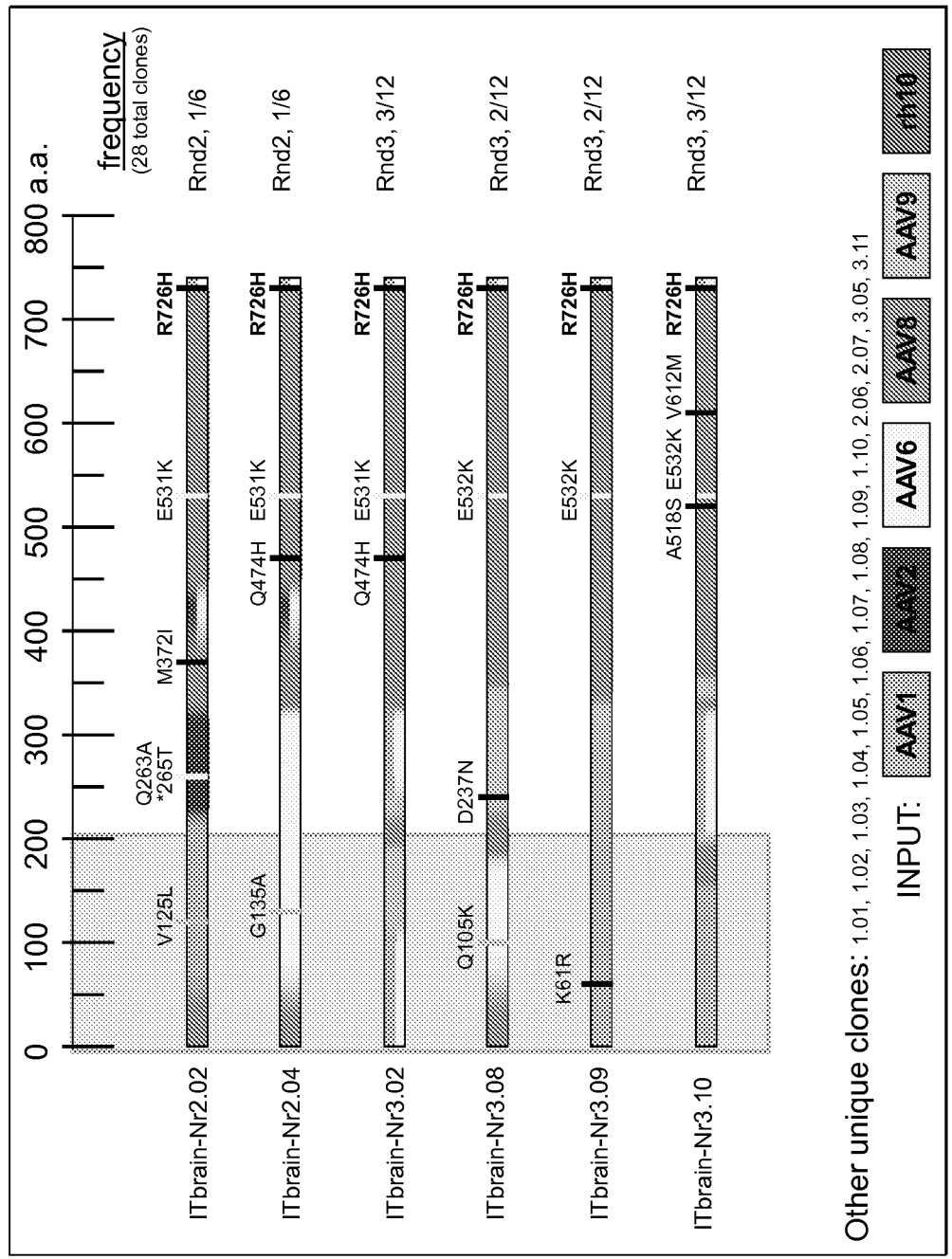
FIG. 2 shows the chimeric structure of AAV capsid clones isolated from the brain of wild-type mice.
Figure 3:
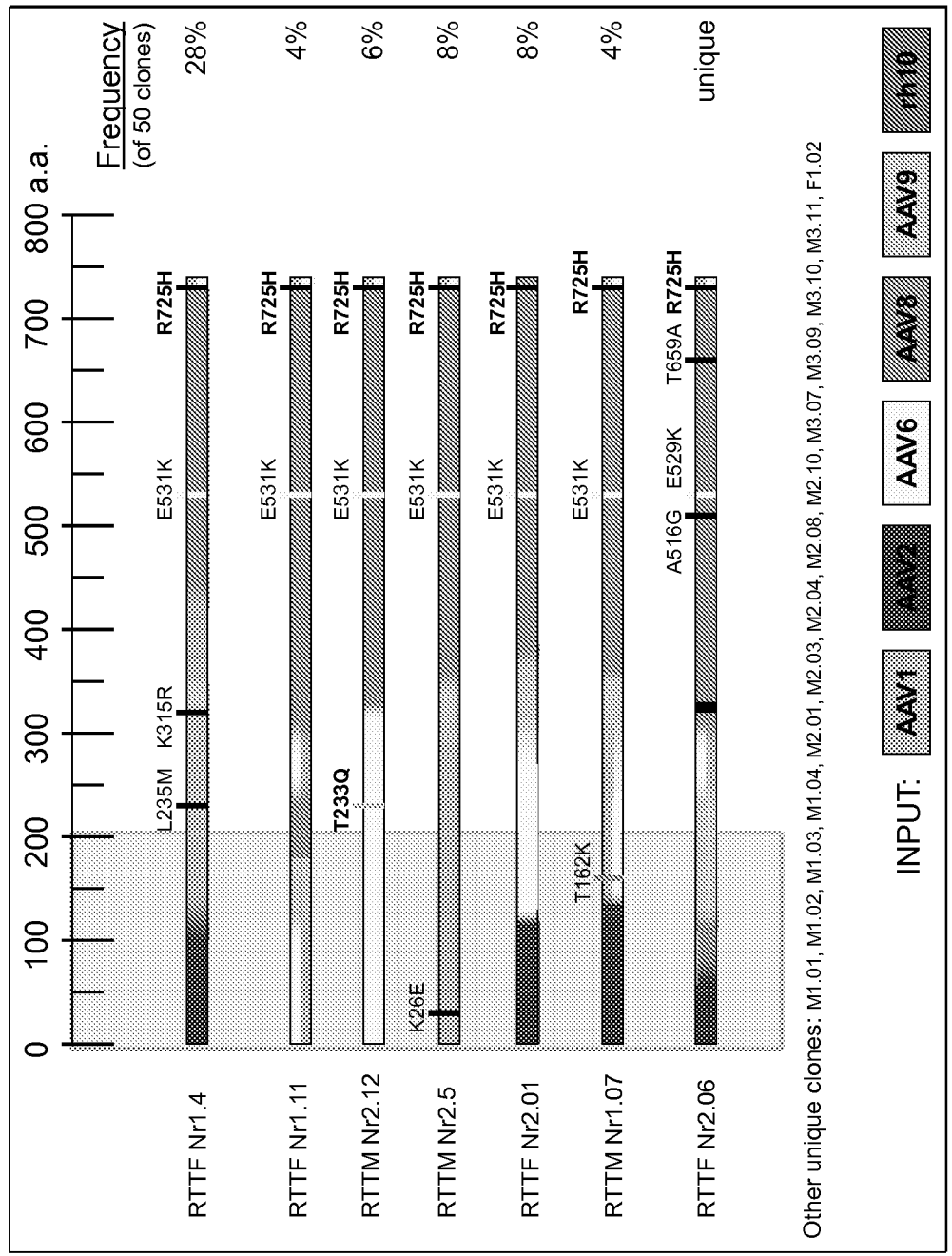
FIG. 3 shows the chimeric structure of AAV capsid clones isolated from Rett Syndrome mice.
Figure 4:
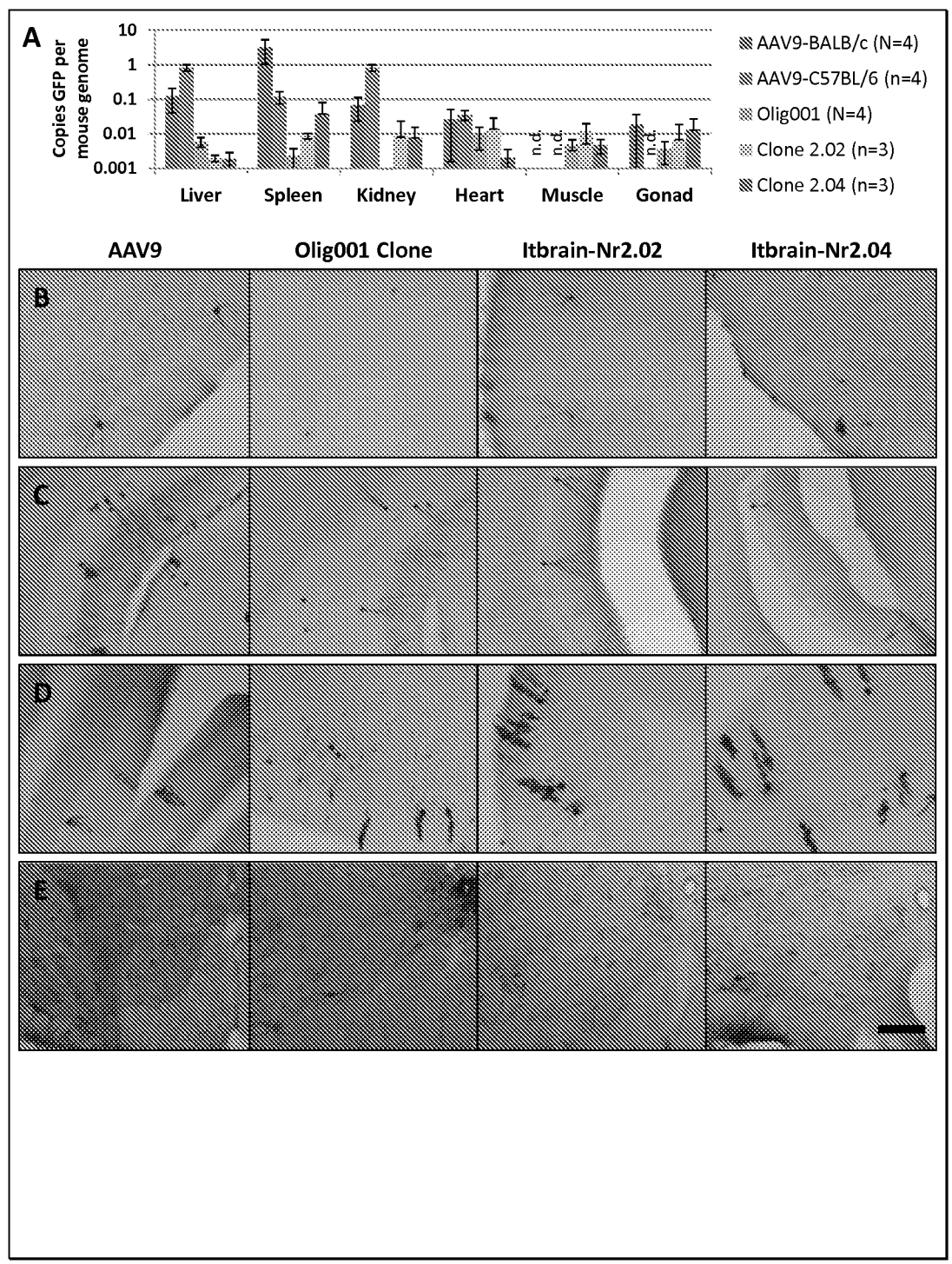
FIGS. 4A-4E show the tropism of isolated clones.
Figure 5:
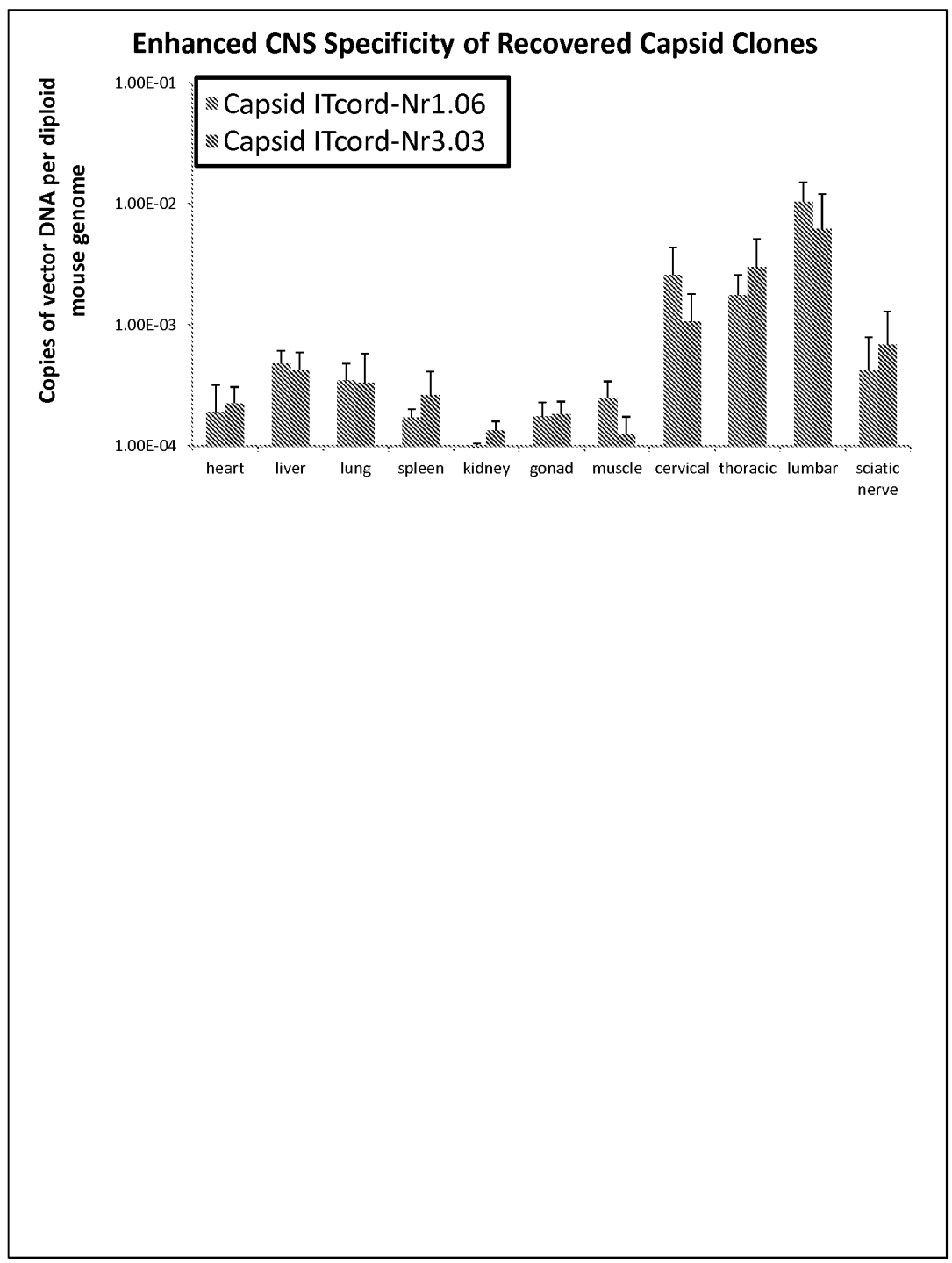
FIG. 5 shows the tropism of isolated clones.
Figure 6:
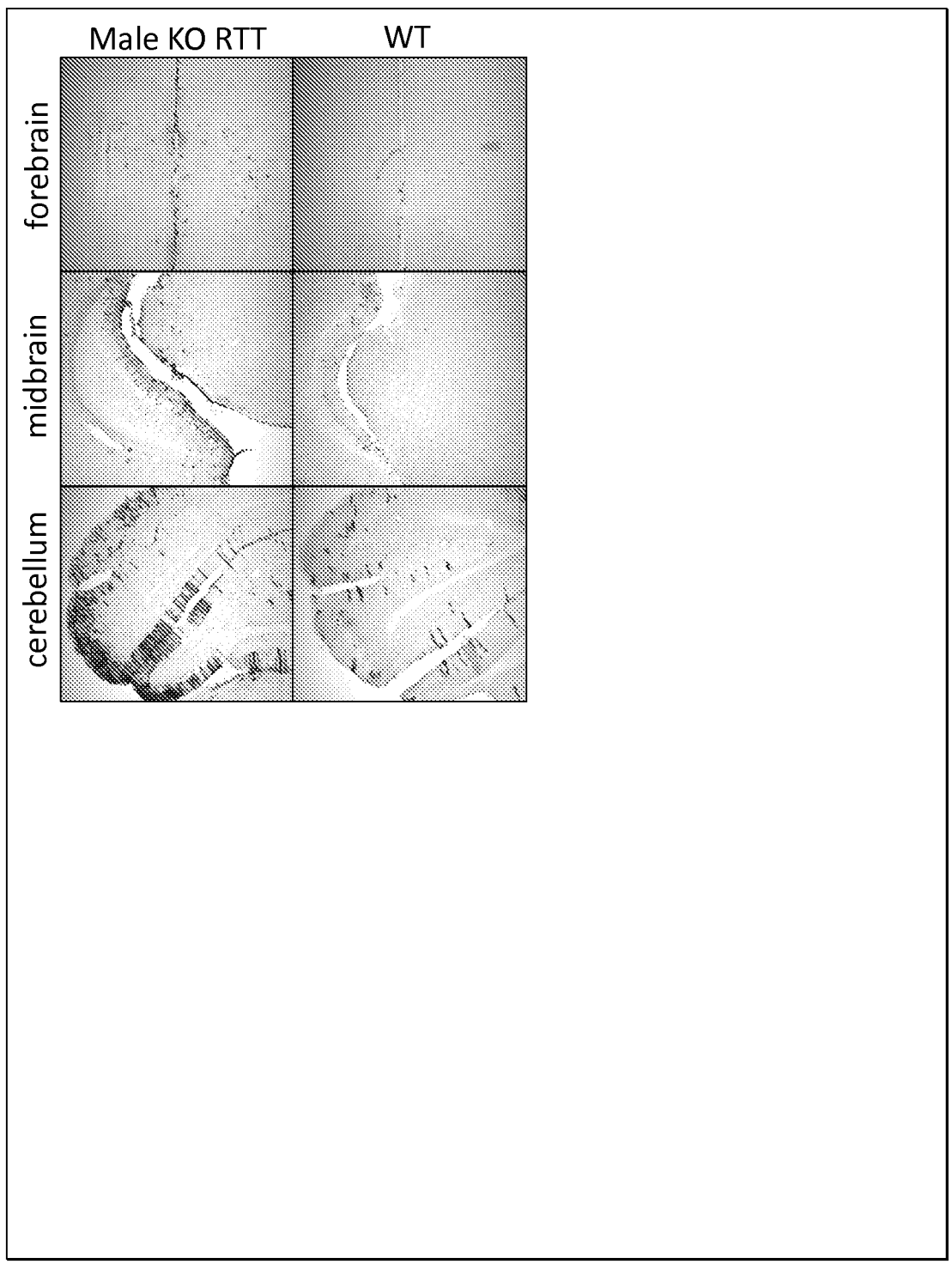
FIG. 6 shows the tropism of isolated clones.

Representative clones are shown in FIGS. 1-3. The CNS tropism of clones ITbrain-2.02 and ITbrain-2.04 is shown in FIGS. 4A-4E. Except where indicated in FIG. 4A, adult WT C57BL/6 mice were injected IT with $1 \times 10^{10}$ vg of the scAAV/GFP vector, then sacrificed at 3 weeks post-injection for IHC of GFP expression and qPCR biodistribution to peripheral organs. FIG. 4B=forebrain, cortex. FIG. 4C=midbrain, hippocampus. FIG. 4D=hindbrain, cerebellum. FIG. 4E shows the ventral horn and central canal of the lumbar spinal cord. n.d.=no data. Scale bars in (A) indicate S.E.M. Scale bar for (B-E) is shown in the lower right and is 100 microns. AAV9 represents a current "gold standard" for widespread CNS gene transfer after intra-CSF administration, and Olig001 is a separately-derived shuffled capsid. FIG. 5 shows the CNS and peripheral distribution of clones ITcord-1.06 and ITcord3.03. Adult WT C57BL/6 mice were injected IT with $1 \times 10^{10}$ vg of the scAAV/GFP vector, then sacrificed at 3 weeks post-injection for qPCR biodistribution to CNS tissues and peripheral organs. Error bars indicate SEM. FIG. 6 shows the CNS tropism of clone RTTF-1.11. The figure shows anti-GFP immunohistochemistry on brain sections from mice that received an intrathecal injection of clone F1.11 (packaging the GFP gene, $1 \times 10^{10}$ vg per mouse) at 4-5 weeks of age, then were sacrificed after 4 weeks. Images from the Rett mouse (left) show stronger transduction along the entire rostral-caudal axis, compared to the WT mouse (right). Representative results are shown.

The transduction efficiency and tropism of 9 chimeric AAV/GFP viruses was tested. Each virus was injected intra-cisternally (5E10 vg per mouse) into three MeCP2+/− female mice that were 5-7 months old (except where otherwise noted). Three weeks after injections, mice were perfused and brains were harvested. After 48 hours of fixation in 1×PBS containing 4% paraformaldehyde, the brains were sectioned at 50 μm using a Leica VT 1000S vibrating-blade microtome. Sections were incubated for 1 hour at room temperature in 5% normal goat serum in 0.3M PBST, then incubated 40-48 hours at 4° C. in primary antibody solution (5% goat serum in 0.3M PBST, chicken anti-GFP (Ayes; 1:500) plus rabbit anti-mouse MeCP2 (Cell Signaling; 1:500), or chicken anti-GFP (Ayes; 1:500) plus rabbit anti-mouse NeuN (Cell Signaling; 1:500)). After washing three times with 0.3M PBST, the sections were incubated for 4 hours at room temperature in secondary antibody solution (0.3M PBST, goat anti-chicken Alexa-fluor 488 (Invitrogen; 1:1000), goat anti-rabbit Alexa-fluor 594 (Invitrogen; 1:1000)), then washed three more times in 0.3M PBST. Sections were then incubated with 0.5 μg/mL DAPI in 0.3M PBST for 30 minutes at room temperature and washed once with 0.3M PBS. Immuno-labeled sections were imaged using a Zeiss LSM 780 confocal microscope. Images were taken using a 20× objective with 4× digital zoom.

Figure 7:
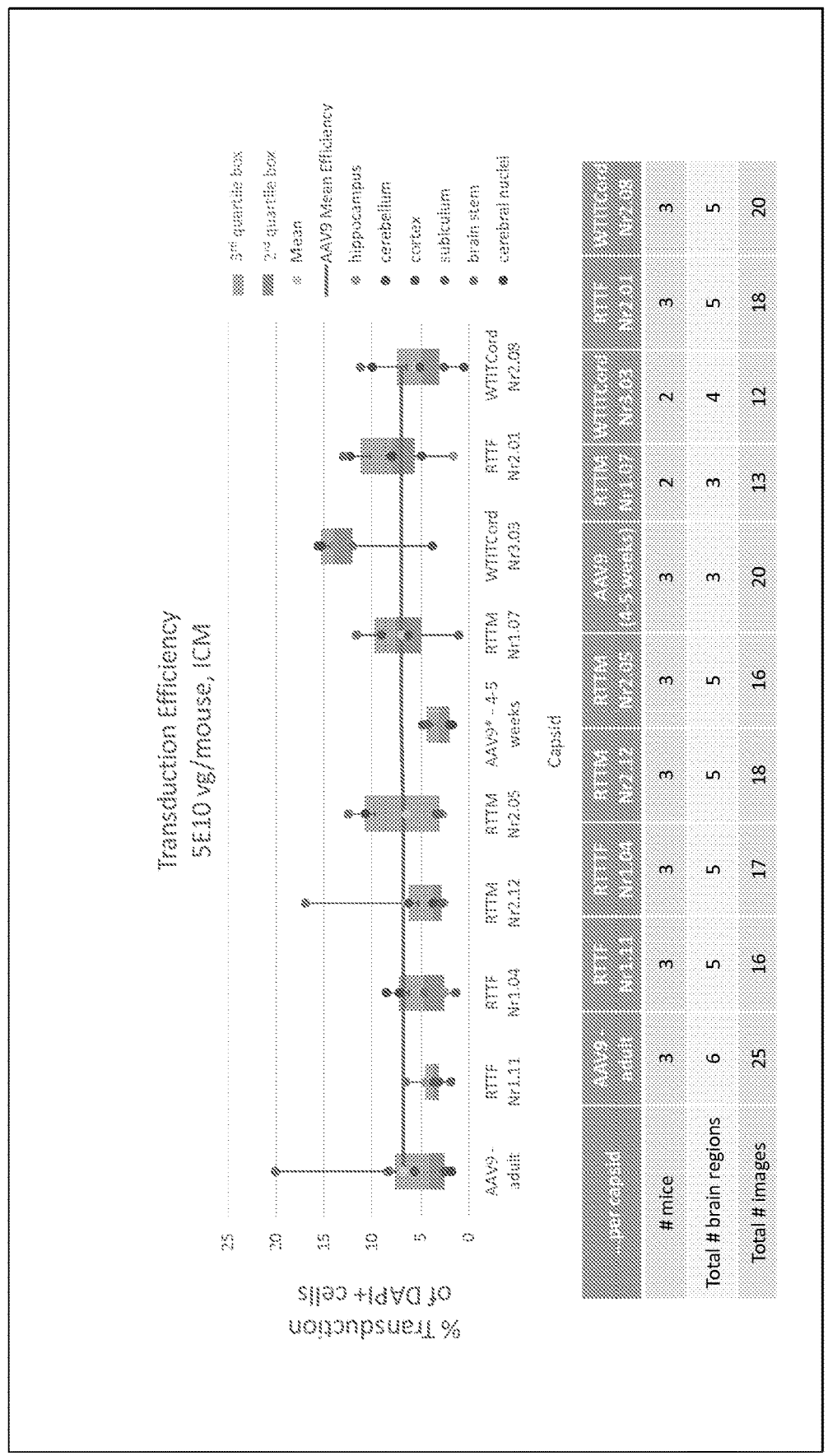
FIG. 7 shows the transduction efficiency of isolated clones.
Figure 8:
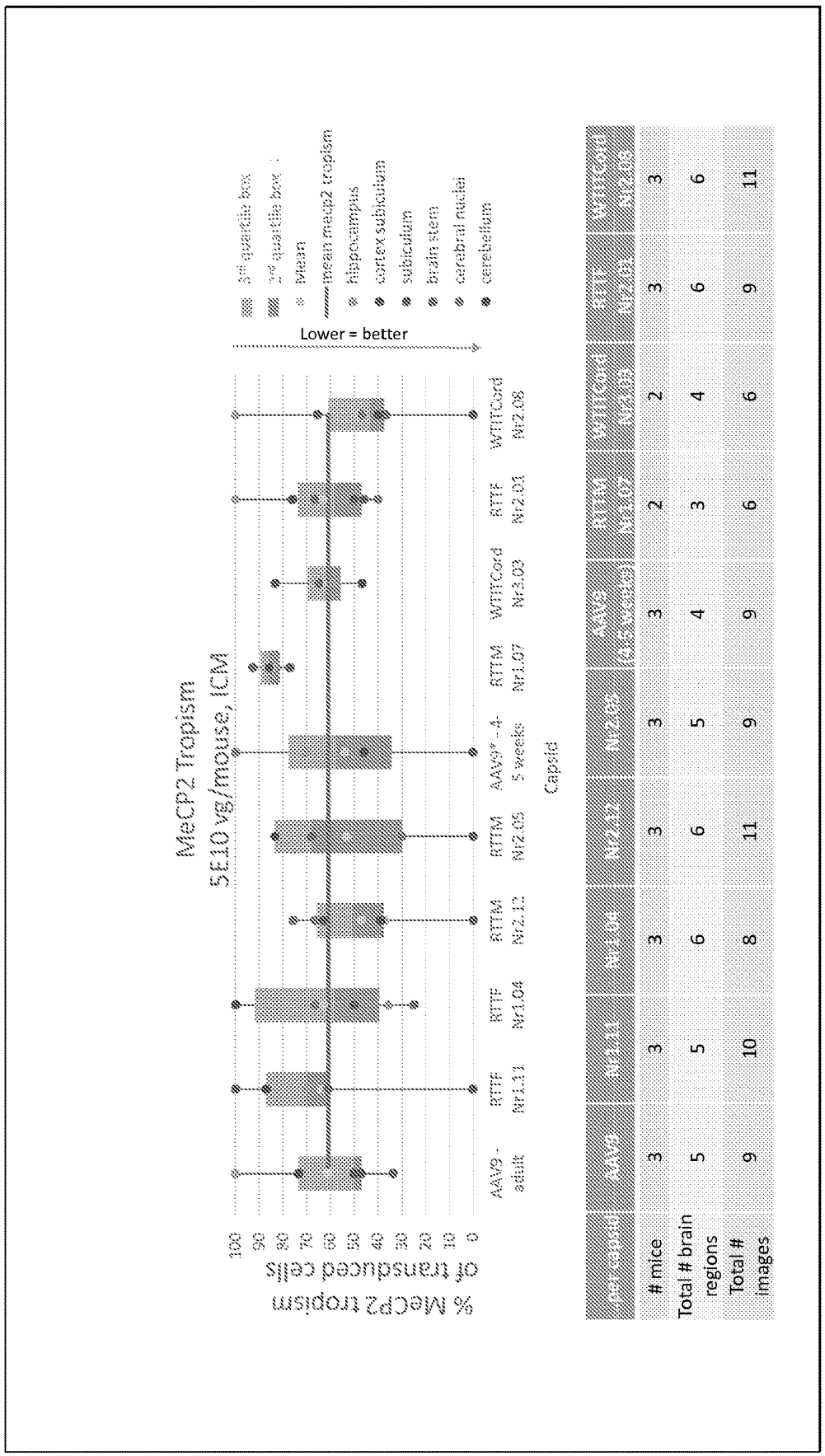
FIG. 8 shows the MeCP2 tropism of isolated clones.
Figure 9:
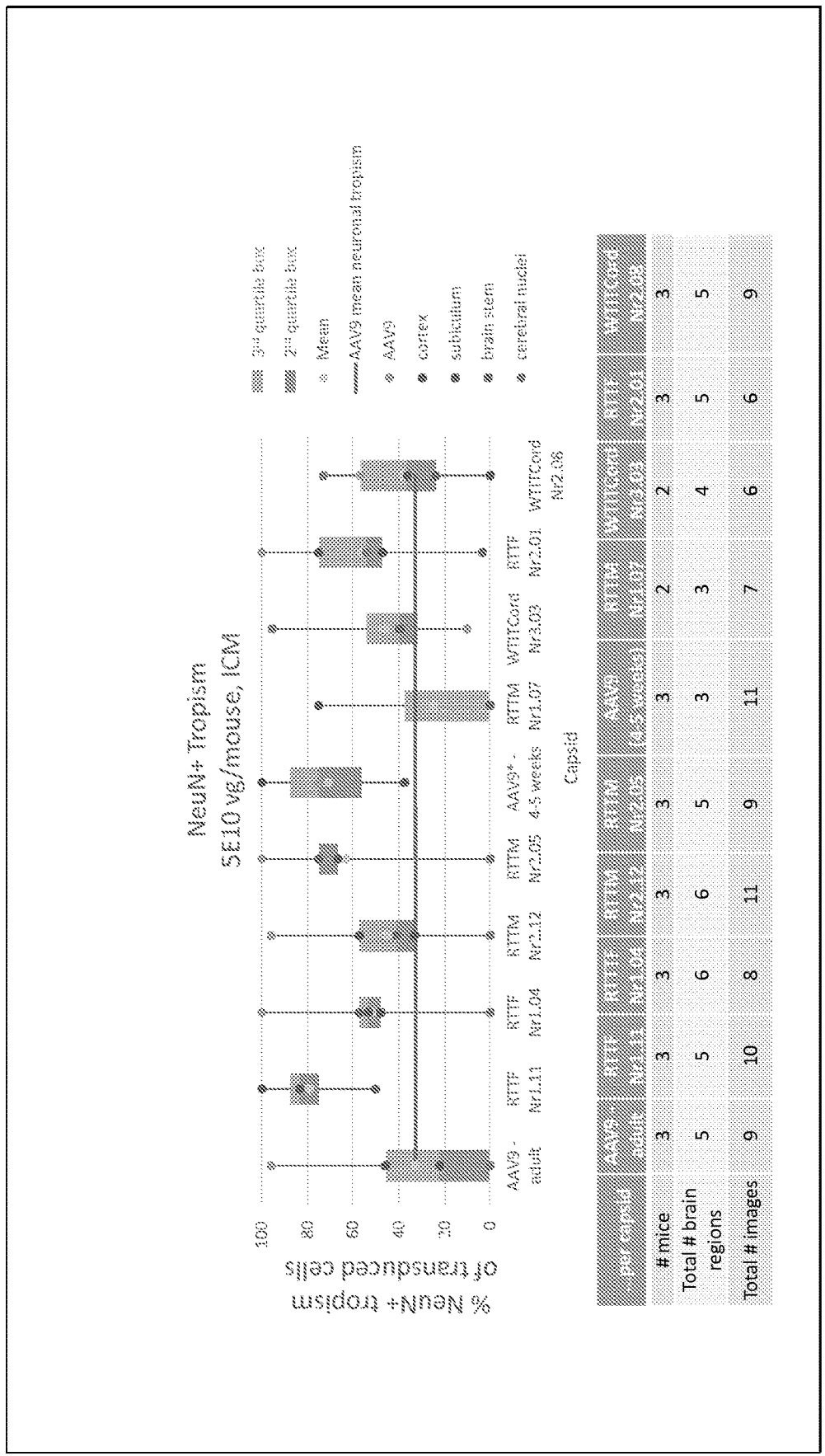
FIG. 9 shows the NeuN tropism of isolated clones.

To estimate the transduction efficiencies for specific brain regions, the ratio of GFP-expressing neurons to DAPI-stained nuclei was calculated for random fields (n=12 25) from sections of hippocampus, cortex, brainstem, subiculum, cerebral nuclei, and cerebellum. The mean transduction efficiency per capsid was calculated by averaging the mean efficiencies across all analyses (FIG. 7). To determine MeCP2 tropism, the ratio of GFP+/MeCP2+ neurons to GFP+ neurons was calculated for each of the following regions: hippocampus, cortex, brainstem, subiculum, cerebral nuclei, and cerebellum (FIG. 8). Cells with glial morphology were not used to calculate MeCP2 tropism as genetically WT glial cells may express MeCP2 at levels that are too low for detection by immunofluorescence. Similar methods were used to calculate NeuN tropism as was done for MeCP2 (FIG. 9).

Example 2

Development of AAV Capsids that Preferentially Target Oligodendrocytes

Materials and Methods
AAV Capsid DNA Shuffling and In Vivo Clone Rescue

A library consisting of shuffled capsids from AAV serotypes AAV serotypes 1-6, 8, 9, rh10, several chimeric capsids and mutant capsids, and an AAV8 with an E533K mutation was produced using methods as previously described (Li et al., *Mol. Ther.* 16:1252 (2008)). The shuffled library was injected intravenously into rats that previously received a striatal 6-hydroxy-dopamine treatment. Three days later, the rats were killed and cells were mechanically dissociated from striatum. DNA was recovered from neuron-enriched samples using the Qiagen DNeasy blood and tissue kit and subsequently concentrated by ethanol precipitation. The Expand Long Template PCR System (cat. no. 11681834001, low starting template, 50 cycles; Roche, Indianapolis, Ind.) was used to recover the intact capsid library sequences, with primers previously described (Li et al., *Mol. Ther.* 16:1252 (2008)). A subsequent error-prone PCR step was employed to further diversify the library between rounds. The pooled mutagenized PCR products were cloned back into a WT AAV backbone (pSSV9) and pooled clones were used to generate the next round's starting library. Pooled clones were transfected into HEK293 cells with an adenovirus helper plasmid (pXX680) and a 10-fold excess of pXR2 containing AAV2 rep and cap. By this method, chimeric capsid genomes were packaged into mostly AAV2 capsids. The titer of the AAV2-encapsidated chimeric library was determined using qPCR. Then, the AAV2-encapsidated chimeras were added to HEK293 cells at a multiplicity of infection of 0.5 vg/cell with WT adenovirus at a multiplicity of infection of 5 infectious units per cell to predominantly package each chimeric AAV genome in its own capsid. After 48 h, the cells were harvested and the virus purified as described (Gray et al., *Gene Ther.* 20:450 (2013)) and titered by qPCR. A total of two rounds of selection were performed. Recovered clones were recovered after each round and subcloned into rAAV pXR2 backbones and SSV9 replication-competent backbones and sequenced.

Cloning

AAV8/E532K was made to introduce the single mutation (E532K, using Olig001 VP1 numbering) in pGSK2/8 (re-pAAV2-capAAV8) using site-directed mutagenesis (Agilent quik change II kit). Primers were designed using the Agilent QuikChange Primer Design Program; forward: 5'GGGAAAAAAACGCTCCTTGTCOTCTTTOTGT-GTTG3' (SEQ ID NO:135) and reverse: 5'CAACACA-CAAAGA CGACAAGGAGCGTTTTTTTCCC (SEQ ID NO:136). Single colonies were grown up and verified by Sanger sequencing. To make Olig001/AAV8 VP3, the N-terminal of Olig001 containing VP1 and VP2 was amplified using forward (F1): 5'AATGTGGATTTGGATGACTG (SEQ ID NO:137) and a mutagenic reverse primer at the VP3 transcription start: 5'CGTTATTOTCTGCCATTGGT-GCGCCACCGCCTGCAGCCATTGTAAGAGA3' (SEQ ID NO:138) resulting in a 659 bp fragment. The C-terminal portion of AAV8 VP3 sequence was amplified from pGSK2/8 using the forward primer used: 5'ACCAATG-GCAGACAATAACGAAG GCGCCGACG-GAGTGGGTA3' (SEQ ID NO:139) and reverse primer used (R2): 5'AGAGCCGAGAACGTAC3' (SEQ ID NO:140) resulting in a 437 bp product. The two PCR products had 20 bp overlapping sequence with each other. The full chimeric cap gene was amplified using both fragments and F1 and R2 primers. The final PCR product (Olig001/AAV8 VP3) and pGSK2/8 was digested with SwaI and BsiWI. The 6266 bp GSK2/8 band and 1070 bp chimeric cap gene PCR product were gel extracted. Fragments were ligated at a 3:1 insert to vector molar ratio using 100 ng of pGSK2/8 vector. Ligation mixes were transformed into Blue-XL (Agilent; 200249) cells and plated onto LB-Amp plates. Single colonies were grown up and verified via Sanger sequencing.

AAV Vector Production

Recombinant AAVs were produced using a triple plasmid transfection method in HEK293 cells, follow by iodixanol gradient centrifugation and ion-exchange chromatography, as previously described (Gray et al., *Gene Ther.* 20:450 (2013)). All AAV vectors were packaged with a self-complementary genome with enhanced GFP under the control of a CMV enhancer, miniature chicken beta actin promoter (CBh), and MVM intron (Gray et al., *Hum. Gene Ther.* 22:1143 (2011)). Peak fractions were dialyzed in phosphate-buffered saline (PBS) with 5% sorbitol, and NaCl added to a final concentration of 350 mM NaCl. Viral titers were obtained via qPCR (see below).

qPCR for Biodistribution Studies and Viral Titer qPCR was used to determine viral titer and for biodistribution studies (Gray et al., Current protocols in neuroscience/editorial board, Jacqueline N. Crawley . . . [et al.] Chapter 4:Unit 4 17 (2011)). All reactions were done using the SyBR Green-based Lightcycler fast start DNA master mix (Roche) on a Roche 480 Lightcycler instrument, following the manufacturer's instructions. To prepare virus samples for titer, they were treated with DNase I for 1 h, then the DNase I was inactivated with the addition of EDTA and heating at 70° C. for 10 min. To liberate the encapsidated viral genomes for qPCR analysis, the reaction mixtures were digested with Proteinase K for at least 2 h at 50° C., then boiled for 10 min to inactivate the Proteinase K. Samples were diluted in PCR-grade water and used as template for qPCR reactions. For GFP virus quantification, plasmid DNA was used as the standard. For quantification of mouse genomic DNA, purified, and quantified mouse genomic DNA was used as a standard. All successful reactions gave a single product by melting curve analysis, used a standard curve with an R2 value of 1, and had a reaction run in parallel containing no template that gave no product. GFP primers were as follows:

```
                                  (SEQ ID NO: 141)
    Forward:    5'AGCAGCACGACTTCTTCAACTCC3'

(SEQ ID NO: 142)
    Reverse:    5'TGTAGTTGTACTCCAGCTTGTGCC3'.
```

LaminB2 primers for quantification of mouse genomic DNA were as follows:

```
                                  (SEQ ID NO: 143)
    Forward:    5'GTTAACACTCAGGCGCATGGGCC3'

(SEQ ID NO: 144)
    Reverse:    5'CCAT CAGGGTCACCTCTGGTTCC3'.
```

To titer the AAV vectors, the following primers were used:

```
                                  (SEQ ID NO: 145)
    Forward:    5'AACATGCTACGCAGAGAGGGAGTGG3'

(SEQ ID NO: 146)
    Reverse:    5'CATGAGACAAGGAACCCCTAGTGATGGAG3'.
```

Animal Procedures

All animals used in these studies were either male Sprague-Dawley rats (Charles River, Morrisville, N.C., USA, 250-250 grams) or adult female C57Bl/6 mice (Jackson Labs, Bar Harbor, Me.) that were maintained in a 12-h light-dark cycle and had free access to water and food. All care and procedures were in accordance with the National Institutes of Health Guide for the Care and Use of Laboratory Animals, and all procedures received prior approval by the University of North Carolina Institutional Animal Care and Use Committee.

6-Hydroxy-Dopamine Treatment

Initially, rats (N=2) were anesthetized with 50 mg/kg pentobarbital, i.p. and placed into a stereotactic frame. Next the rats received a unilateral infusion of 6-hydroxy-dopamine (2 µl, 20 µg) into the right striatum (0.5 mm anterior to bregma, 3.5 mm lateral, 5.5 mm vertical, according to the atlas of Paxinos and Watson (Paxinos G, Watson C., The rat brain in stereotaxic coordinates, 6th ed. Academic Press/Elsevier, Amsterdam; Boston (2007)). This treatment results in a significant reduction in striatal dopamine content 14 days post-treatment.

AAV Capsid Library Administration

The AAV capsid library was administered 14 days post-6-hydroxy-dopamine treatment. For each selection round 2 rats initially were anesthetized with pentobarbital (50 mg/kg i.p.) and subsequently received an intravenous tail vein injection of the AAV capsid library virus. Three days later, the rats were euthanized and the right striatum was dissected out. Subsequently, cells were mechanically dissociated as previously described (Gray et al., *Mol. Ther.* 18:570 (2010)) for subsequent PCR clone rescue.

Stereotactic AAV vector administration

As above, rats were anesthetized with pentobarbital and placed into a stereotactic frame. Each of the different AAV clones were in phosphate-buffered saline (PBS), 5% sorbitol and 350 mM NaCl) were infused at a rate of 1 µl/5 min) into the striatum (0.5 mm anterior to bregma, 3.5 mm lateral, 5.5 mm vertical, according to the atlas of Paxinos and Watson (Paxinos G, Watson C., The rat brain in stereotaxic coordinates, 6th ed. Academic Press/Elsevier, Amsterdam; Boston (2007)). The rats were sacrificed for immunohistochemical evaluation 14 days post-vector infusion.

Immunohistochemistry

Fourteen days post-vector infusion, rats received an overdose of pentobarbital (100 mg/kg, i.p.) and subsequently were perfused transcardially with 100 ml of ice-cold 0.1 M PBS pH 7.4 (25 ml/min) followed by 180 ml of ice-cold 4% paraformaldehyde-phosphate buffer (pH 7.4)(30 ml/min). Each brain was post-fixed in 4% paraformaldehyde-phosphate buffer (pH 7.4) overnight at 4° C. Fixed brains were sectioned coronally on a Leica vibratome (40-μm thick) and stored in ice-cold 0.1 M PBS pH 7.4 until further processing. For immunostaining, slides were washed three times for 5 min in 0.1 M PBS pH 7.4, then blocked in 10% goat serum and 0.1% Triton-X in 0.1 M PBS pH 7.4 for 30 min. Primary antibodies NeuN (1:500; Millipore; MAB377) and GFAP (1:2000; Dako; Z0334) were incubated in 5% goat serum and 0.05% Triton-X in 0.1 M PBS pH 7.4 at 4° C. with gentle agitation overnight. Sections were washed in 0.1 M PBS pH 7.4 and blocked again as described above. Secondary goat anti-mouse Alexa 594 (A11032) for NeuN or goat anti-rabbit Alexa 594 (A11080) for GFAP (both 1:500 in 5% goat serum and 0.5% Triton-X in 0.1 M PBS pH 7.4 with gentle agitation at 4° C. for 45 min). Sections were washed with 0.1 M PBS pH 7.4 three times for 5 min each. Sections were floated and put on glass slides and dried overnight at room temperature. Slides were mounted with fluorescent mounting media and cover slipped. Confocal imaging was performed at the Michael Hooker Microscopy Core at UNC-Chapel Hill using a Leica Sp2 confocal. Slides were visualized using the 40× objective using sequential laser scanning to obtain z-stacks. Z-stacks were approximately 4 μm with 10-12 slices 0.36 μm thick per stack. Stacks were flattened in the Leica software and processed in Image J. At least five independent fields were used to count GFP positive cells and their co-labeling with NeuN or GFAP to determine tropism.

Biodistribution

Adult female C57Bl/6 mice (Jackson labs; Bar Harbor, Me.) were intravenously injected in the tail vein with $5 \times 10^{10}$ vg (~$2.5 \times 10^{12}$ vg/kg body weight) in 200 μl PBS with 5% D-sorbitol. Ten days post injection organs were harvested. Total DNA from each organ was extracted with Qiagen DNeasy blood and tissue kit and total copies of GFP and mouse genomic LaminB2 were determined by qPCR. Data was compiled from 5 mice for AAV8 and 4 mice for Olig001.

In Vitro Binding

Mixed glia cultures were prepared from C57BL/6J day three neonatal pups. Forebrains were minced, dissociated, and washed prior to plating in T75 flasks. Cells were removed from the flasks and then replated into five 35-mm tissue culture dishes with approximately $5 \times 10^5$ cells. At 95% confluency four AAV viruses containing the CBh-GFP reporter genome (Olig001/AAV8 VP3; Olig001; AAV8; AAV8/E532K) were diluted and added separately, in quadruplicate, at a MOI of 100 vg/cell and were incubated at 4° C. with mixing every 10 min for 1 h. Plates were rinsed with ice cold PBS 3 times, cells scraped from the plates, pelleted, and frozen at −80° C. A PBS only dish was also included as a mock sample. DNA was isolated from the samples using the Qiagen DNeasy blood and tissue kit. The amount of viral GFP and mouse genomic LaminB2 was determined by qPCR. Statistical analysis and graphing was done in Prism. Outliers were determined using the Grubbs test and subsequently removed. Statistical significance ($P<0.05$) was determined using a one-tailed Mann-Whitney test. The fold change was determined from the average of each virus from AAV8.

Results

Identification of an Oligodendrocyte Preferring AAV Capsid

A shuffled AAV capsid library was administered intravenously 2 weeks after the unilateral administration of 6-hydroxy-dopamine (6-OHDA), and 3 days later AAV clones were recovered by PCR from dissociated striatal cells. Surprisingly, 10 of 10 selected clones had highly similar, if not identical sequences. Even with a second round of capsid shuffling, library administration and clone selection, 12 out of 12 clones had almost identical sequences, similar to the first round (FIG. 10A). When the chimeric virus (named Olig001) was administered intravenously to unilateral 6-OHDA treated rats, 2 weeks later immunohistochemistry revealed only a few GFP positive neurons in the ipsilateral striatum and a sparse number of oligodendrocyte like cells. In marked contrast, 2 weeks after a striatal infusion of the Olig001 clone into naïve rats, oligodendrocytes comprised the vast majority of the transduced cells, even though the gene expression was driven by the constitutive CBh promoter (FIGS. 10B-10E). GFP positive cells exhibited the typical oligodendrocyte morphology with clear labeling of myelin in the striatal patch/matrix (FIGS. 10B-10C). Furthermore, GFP positive cells did not co-localize with glial fibrillary acidic protein (GFAP), an astrocyte marker (FIG. 10D), and approximately only 5% of the GFP positive cells co-localized with NeuN, a neuronal marker (FIG. 10E). Thus, almost all of the GFP positive cells (>95%) were oligodendrocytes with only a few neurons and no GFP positive astrocytes or microglia. This change in tropism directly contrasts the neuronal tropism characteristic of AAV8 which shares 99.3% homology (7 amino acid differences) with the VP3-specific portion of the Olig001 capsid sequence (FIG. 10A).

Olig001 is Detargeted from Peripheral Tissues

Figure 11:
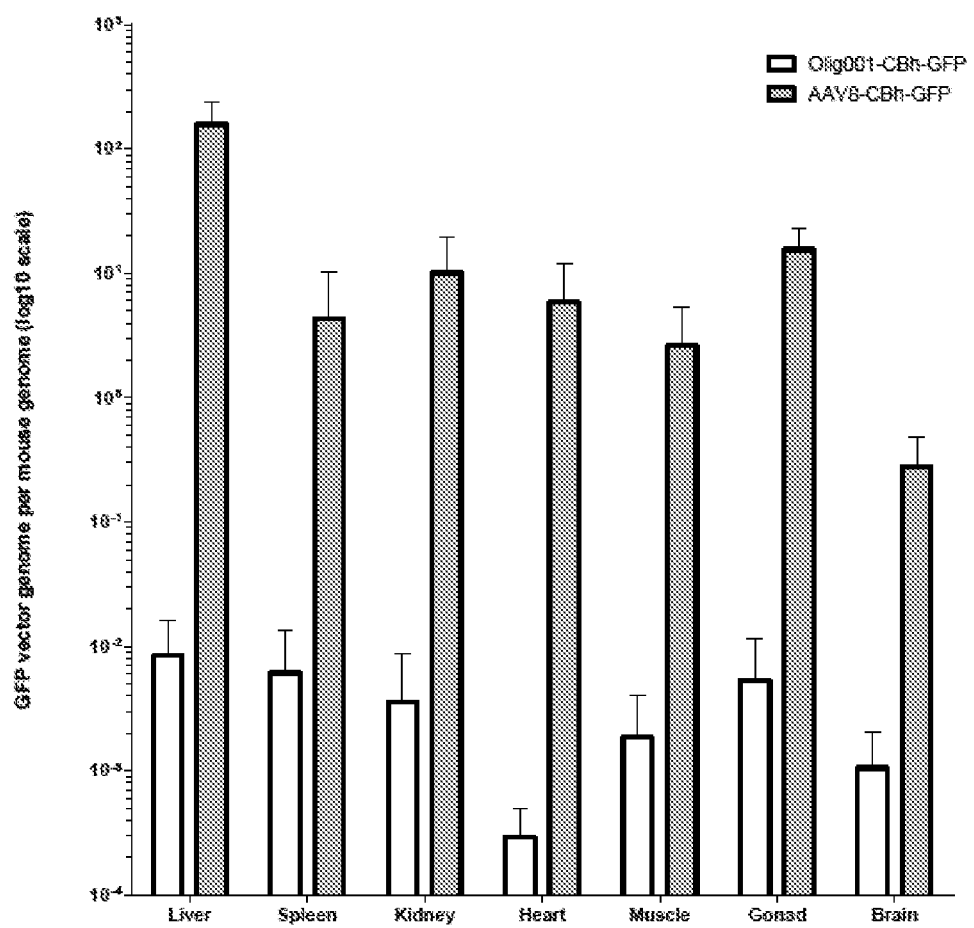
FIG. 11 shows Olig001 is detargeted from peripheral tissues compared to AAV8. Adult female C57Bl/6 mice received an intravenous dose of $5\times10^{10}$ vg (~$2.5\times10^{12}$ vg/kg body weight) of either Olig001-CBh-GFP (white bars; n=4) or AAV8-CBh-GFP (gray bars; n=5). Ten days later the organ distribution of GFP genome per diploid mouse genome (LaminB2) was determined by qPCR. Error bars indicate standard error of the mean.

Given that the selection process involved intravenous administration of the capsid library, we sought to characterize the biodistribution of Olig001 in wild type rodents compared to AAV8. Adult female C57Bl/6 mice received intravenous administration of equal amounts of either virus. Ten days later, organs were harvested, and the biodistribution was quantified by qPCR for Olig001-CBh-GFP (white bars) and AAV8-CBh-GFP (gray bars) (FIG. 11). The biodistribution of Olig001 was significantly reduced in all peripheral organs tested compared to AAV8, especially the liver (FIG. 11). Together with our previous results, these data indicate that Olig001 has a highly divergent tropism from the related AAV8, both within and outside the CNS.

E532K Mutation in AAV8 Produces a Tropism Switch from Neurons to Oligodendrocytes Of the 7 amino acids that distinguish Olig001 from the VP3 region of AAV8, only 1 residue (E532K using Olig001 VP1 numbering or E533K using AAV8 VP1 numbering) has been previously associated with alterations in receptor/ligand interactions (Wu et al., *J. Virol.* 80:11393 (2006)). Wu and colleagues discovered that the difference in tissue tropism and ligand binding seen between closely related AAV1 and AAV6 is solely explained by a lysine or glutamate at the corresponding 532 residues and that the E533K mutation in AAV8 conferred a new ability to bind heparin sulfate (Wu et al., *J. Virol.* 80:11393 (2006)). Subsequently, we tested the influence of the E532K mutation on the tropism of AAV8 in the brain (FIG. 12A). AAV8/E532K was packaged with CBh-GFP and injected at a titer of $2 \times 10^8$ vg/μl into the striatum of wild-type male Sprague-Dawley rats. Two weeks post injection the brains were harvested and assessed for native GFP co-localization with neuronal (NeuN) and astrocyte (GFAP) markers (FIGS. 12B-12G). Native GFP did not co-localize with either neuronal (FIGS. 12B-12D) or astrocyte (FIGS. 12E-12G) markers. In contrast, GFP positive cells exhibited the characteristic morphology of oligodendrocytes. Together, AAV8 with the E532K mutation changes the tropism of AAV8 from neuron-preferring to oligodendrocyte-preferring, suggesting a role for the same residue in Olig001 to direct oligodendrocyte tropism. However, in the context of Olig001, we found that reversing the mutation (K532E) did not affect the oligodendrocyte tropism (summarized in FIG. 15).

Olig001 Oligodendrocyte Tropism is Conferred by Amino Acids Outside of VP3

Figure 15:
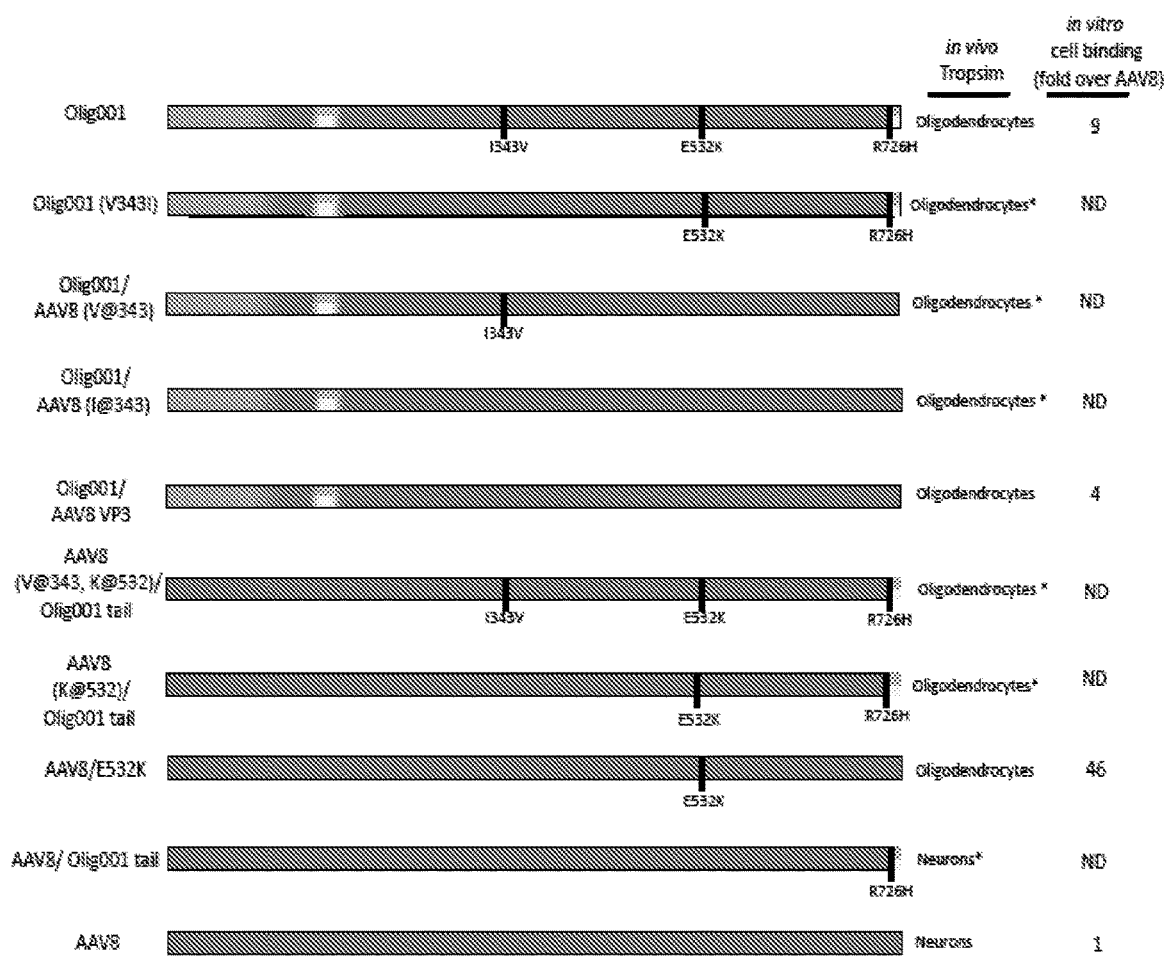
FIG. 15 shows a summary of the findings. Diagrams of the cap genes used in this study with the in vivo dominant tropism when infused into the adult rat striatum and in vitro binding fold over AAV8. The different colors represent a different AAV parental serotype (blue=AAV2, purple=AAV8, red=AAV9, yellow=AAV1, and orange=AAV6). The black vertical bars indicate point mutations. ND=not determined and * indicates data not shown.
Figure 16:
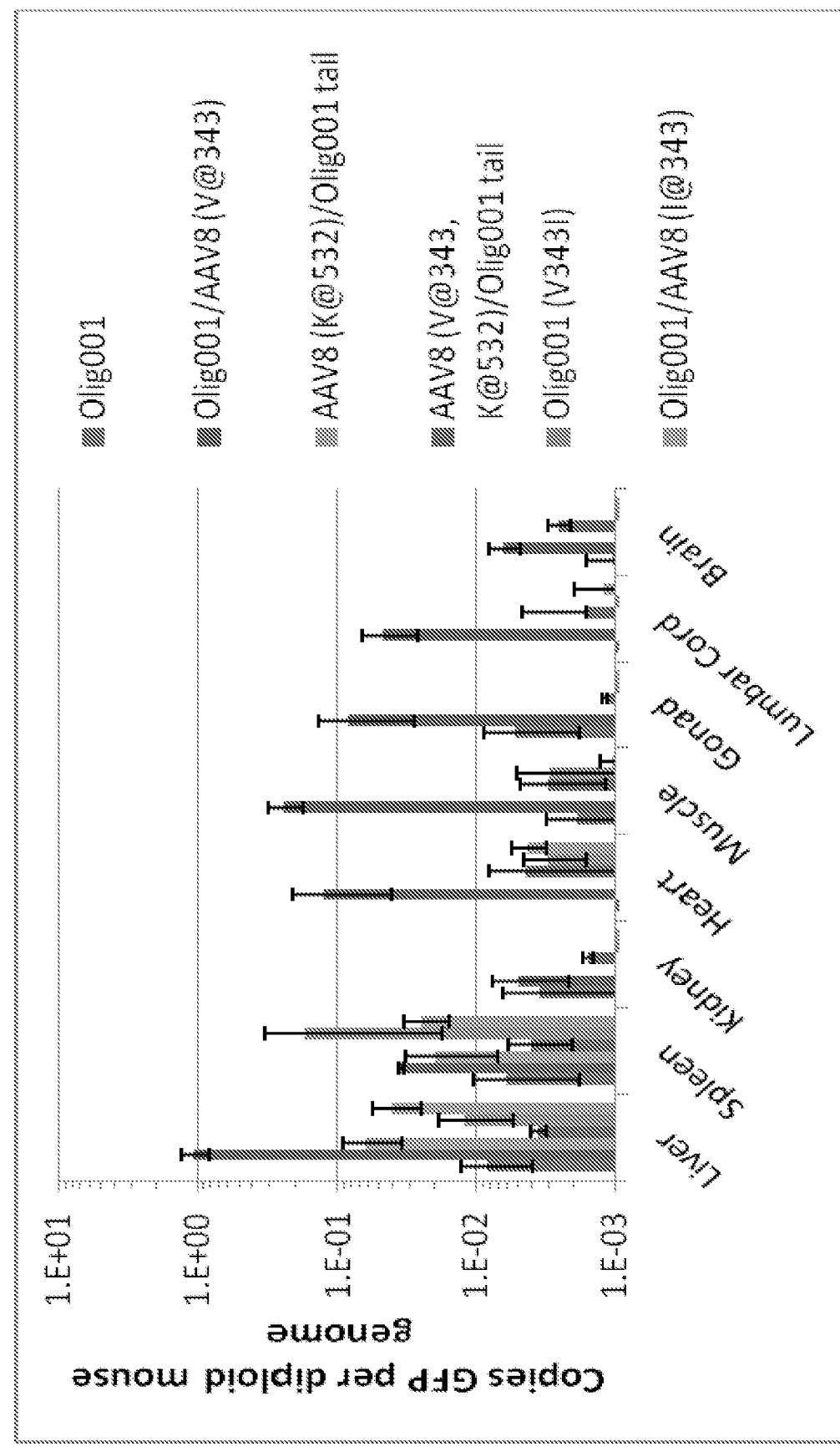
FIG. 16 shows mutants derived from Olig001 are detargeted from peripheral tissues compared to AAV8 (see also FIG. 11). Adult female C57Bl/6 mice received an intravenous dose of 5×10$^{10}$ vg (~2.5×10$^{12}$ vg/kg body weight) of either Olig001 or one of its mutant derivatives, as indicated, packaging the sc CBh-GFP genome. Ten days later the organ distribution of GFP genome per diploid mouse genome (LaminB2) was determined by qPCR. Error bars indicate standard error of the mean.

Traditionally, only VP3 residues are thought to contribute to extracellular receptor binding and the tropism of AAV serotypes, while specific VP1 and VP2 portions of the N-terminal portions mediate endosomal escape and nuclear import (Bleker et al., *J. Virol.* 79:2528 (2005); Grieger et al., *J. Virol.* 80:5199 (2006); Kronenberg et al., *J Virol.* 79:5296 (2005); Sonntag et al., *J. Virol.* 80:11040 (2006)). To identify the specific amino acids of the Olig001 capsid that contribute to oligodendrocyte tropism, we made Olig001 mutants that return the 7 residue differences within VP3 to AAV8 residues. However, no single or cluster of mutation(s) within Olig001 VP3 decreased the oligodendrocyte tropism of Olig001 in the rat striatum to less than 98% of cells (summarized in FIG. 15). Similarly, the peripheral organ biodistribution was highly reduced in all the tested mutants, with the greatest reduction seen in the mutants that retained the VP1/VP2-specific region Olig001 (FIG. 16). As a next step, we replaced all of the Olig001 VP3 sequence with AAV8 VP3 sequence to assess the overall contribution of VP3 (FIG. 13A). Mutant Olig001 with an AAV8 VP3 (Olig001/AAV8 VP3) was packaged with CBh-GFP and injected into the striatum of wild-type male Sprague-Dawley rats. Two weeks later, the brains were harvested and assessed for native GFP co-localization with neuronal (NeuN) and astrocyte (GFAP) markers (FIGS. 13B-13G). Native GFP rarely (in 2% of cells) co-localized with NeuN (FIGS. 13B-13D) and did not co-localize with GFAP (FIGS. 13E-13G). Additionally, the GFP positive cells exhibited the characteristic morphology of striatal oligodendrocytes. These results suggest that VP1/VP2-specific portion of the capsid have a previously unappreciated influence on AAV tropism.

In Vitro Binding Data

Figure 14A:
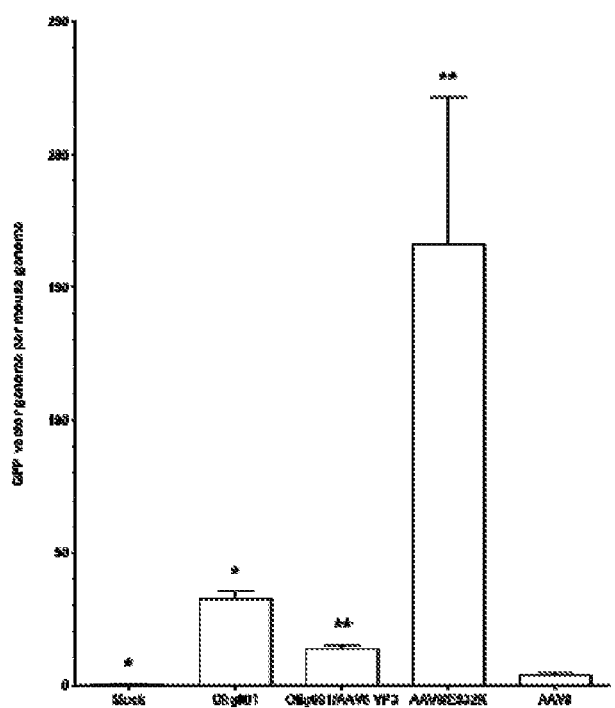
FIGS. 14A-14B shows that in vitro binding analysis agrees with in vivo tropism. In vitro mixed glia cultures were created by dissociating neonatal day 3 mouse brains. Cultures were incubated with an equivalent amount of either AAV8-CBh-GFP or Olig001-CBh-GFP for 1 h at 4° C. to allow for vector binding, but not uptake. (A) The amount of vector bound to cells was quantified by qPCR for OFF and normalized to mouse genomic LaminB2. Error bars indicate Standard Error of the Mean, * indicates a significant difference of $P<0.03$, and ** indicates a significant difference of $P<0.01$. (B) The fold difference was determined using the average binding for each virus compared to AAV8.
Figure 14B:
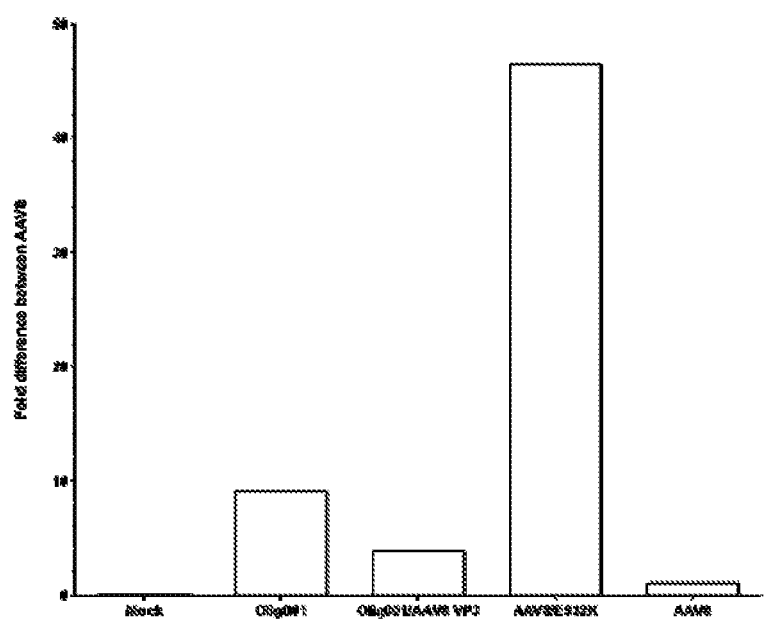

The VP1/VP2-specific portions of the Olig001 capsid could be directing the preferred transduction of oligodendrocytes through increased extracellular binding to receptor(s) on oligodendrocytes, or via enhanced intracellular trafficking by an unknown mechanism that could be specific to oligodendrocytes. To distinguish between these 2 scenarios, we performed an in vitro binding experiment using mixed glia cultures, including Olig001, the Olig001/VP3 AAV8 mutant, AAV8, and the AAV8/E532K mutant all packaged with CBh-GFP. Mixed glia cultures were incubated with an equivalent amount of each virus for 1 h at 4° C. This procedure allows vector binding to the cell surface, but prevents internalization (Xiao et al., *Mol. Ther.* 20:317 (2012)). The amount of vector bound to cells was quantified by qPCR for GFP and normalized to mouse genomic LaminB2 (FIG. 14A). Consistent with our in vivo results, Olig001 bound to the mixed glial cell population 9-fold more than AAV8 (FIG. 14B). The binding of Olig001/AAV VP3 was slightly lower than Olig001 (4-fold over AAV8), while AAV8/E532K bound 46-fold more than AAV8 (FIG. 11B). These results suggest that both the E532K mutation and the VP1/VP2-specific N-terminal domain each contribute to the oligodendrocyte tropism of Olig001 in a redundant fashion. Therefore, the in vitro data agrees with the observed in vivo tropism data.

These studies generated a novel chimeric AAV capsid variant with a preferential in vivo tropism for oligodendrocytes, a finding that represents a major departure from the normal neuronal tropism of the chimera's parental AAV serotypes. Past studies have described the ability of AAV2 or AAV8 to transduce oligodendrocytes at a low efficiency, but these studies required the use of oligodendrocyte promoters to prevent expression in neurons, the preferred cell type for these vectors (Chen et al., *J. Neurosci. Res.* 55:504 (1999); Chen et al., *Gene Ther.* 5:50 (1998); Klein et al., *Mol. Ther.* 13:517 (2006); Lawlor et al., *Mol. Ther.* 17:1692 (2009)). In contrast, the Olig001 has the ability to efficiently and preferentially transduce oligodendrocytes following intracranial administration, using a ubiquitous promoter. Thus, Olig001 has a preferred tropism for oligodendrocytes and low tropism for neurons, which is distinct from any previously reported AAV capsid.

We identified two separate and redundant regions of the Olig001 capsid that are sufficient to drive this oligodendrocyte tropism. Interestingly, mutation of a single amino acid, E532K, in AAV8 (AAV8/E532K) is sufficient to strongly reduce its neuronal tropism in favor of a gained tropism for oligodendrocytes. However, this oligodendrocyte preference does not arise from a simple loss of neuronal tropism, because the AAV8/E532K mutant shows significant increased binding (46-fold over AAV8) to oligodendrocytes in vitro (FIG. 15). The second domain of Olig001 that confers its oligodendrocyte tropism is perhaps more interesting, given its location within the VP1/VP2-specific N-terminus of the capsid ORF. The VP3-specific region of the capsid (which accounts for 54 of the 60 total capsid subunits per virion (Johnson et al., *J Virol.* 8:860 (1971); Rose et al., *J. Virol.* 8:766 (1971)) is generally thought to contain the major elements involved with receptor binding (reviewed in (Agbandje-McKenna et al., *Meth. Mol. Biol.* 807:47 (2011)). In marked contrast, the VP1/VP2 dependent shift in AAV tropism demonstrates that manipulation of the VP3 sequence is not the only contributing factor to AAV vector tropism. Clearly, our findings indicate that VP1 and VP2 (which accounts for 54 of the 60 total capsid subunits per virion (Johnson et al., *J. Virol.* 8:860 (1971); Rose et al., *J Virol.* 8:766 (1971)) can exert a major influence on AAV vector tropism which arises from the extracellular binding rather than intracellular trafficking.

The Olig001 vector described herein could be useful for in vivo and in vitro research applications requiring gene transfer to oligodendrocytes, which are typically refractory to efficient chemical transfection or vector-mediated transduction. Moreover, the ability to efficiently target oligodendrocytes in vivo could advance therapeutic strategies for demyelinating diseases such as Canavan Disease or Krabbe Disease. These studies further challenge the generally accepted notion that the tropism of AAV is dictated solely by the VP3-specific portion of the capsid rather than the VP1/VP1-specific N-terminal domains.

The foregoing is illustrative of the present invention, and is not to be construed as limiting thereof. The invention is defined by the following claims, with equivalents of the claims to be included therein.

SEQUENCE LISTING (146 sequences)

SEQ ID NO: 1 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaggccggagacaacccgtacctcaagtacaaccacgccgacgccgagttccaggagcggctcaaagaagatacgtcttttgggggcaacctcggacgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccgacccaagagactcaacttcaagctctttaacattcaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaagaaaacagcaaacgctggaacccagagattcaatacacttccaactactacaaatctacaagtgtggactttgctgttaatacagaaggcgtgtactctgaaccccaccccattggcacccgttacctcacccgtcccctgtaa

SEQ ID NO: 2 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaagccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 3 - DNA, 2214 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaatacggctcctggaaagaaacgtccggtagagcagtcgccacaagagccagactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcctcacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagtcaaggagccttacctggcatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacaccaccaactactacaaatctacaagtgtggactttgctgttaatacagaaggcgtgtactctgaaccccaccccattggcacccgttacctcacccgtcccctgtaa

SEQ ID NO: 4 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaggccggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaacagattccactgccacttttcaccacgtgactggcaaagactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctccctccgttcccggcggacgtgttcatgattccgcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 5 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattcccaatggctgggcgacagagtcatcaccaccagcaccagaacctgggccttgcccacctataacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggttcaagtcttctcggactcggagtaccagttgccgtacgtcctcggctctgcgcaccagggctgcctccctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 6 - DNA, 2244 bp, Artificial
  Recombinant AAV capsid clone coding sequence
  misc_feature (2241)..(2241): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcaccagatacctgactcgtaatctgtaattgcttgttaatcaataaaccgtttaattnttt

SEQ ID NO: 7 - DNA, 2217 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataaccacgccgacgccgagtttcaggagcgtctgcaagaagatacgtcttttgggggcaacctcggacgagcagtcttccaggcgaaaaagagggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaaccgcttccactgccacttctcaccacgtgactggcagcgactcatcaacaacaactggggattccggcccaagagactcagcttcaaactcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattcctcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggacttaagcacccgcctcctcagatcctcatcaaaaacacgcctgttcctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 8 - DNA, 2214 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcacccatgcaagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 9 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 10 - DNA, 2214 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaatttgggatcccggcccaagagactcaacttcaagctcttcatcatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 11 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaaacgtccggtagagcagtcgccacaagagccagactcctcctcgggcattggcaagacaggccagcagcccgctaaaaagagactcaactttgggcagactggcgactcagagtcagtgcccgaccctcaaccaatcggagaacctccagcaacccccgctgctgtgggacctactacaatggcttcaggcggtggcgcaccaatggcggacaataacgaaggcgccgatggagtgggtaattcctcgggaaattggcattgcgattccacatggctgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgatccccaccccattggcacccgttacctcacccgtcccctgtaa

SEQ ID NO: 12 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaagagcaggacgacggccggggtctggtgcttcctggctacaagtacctcggacccttcaacggactcgacaagggagagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcatgattccgcagtacggctacctaacgctcaacaatggtagccaggcagtgggacggtcatcctttttctgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgagacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 13 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggacaggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagaacagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtagacaacaatggactttatactgtgcctcgccccattggcacccgttacctcacccgtcccctgtaa

SEQ ID NO: 14 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgcggcggacgcggcggccctcgaacacgacaaggcttacgaccagcagctcaaggcgggtgacaacccctacctgcggtataaccacgccgacgccgagttccaggagcggctgcaagaagatacgtcttttgggggcaacctcgggcgagcagtcttccaggccaaaaagaggcttcttgaacctcttggtctggttgaggaaggcgctaagacggctcctggaaagaagaggcctgtagagcagtctcctcaagaaccggactcctcctcgggtattggcaaaacaggtgagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagtgcctcaggaaattggcattgcgattccacatggctgggcgacagagtcatcaccaccagcacccgaacctgggccctgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgttcacggactcagagtatcagctgccgtacgtgctcgggtcggctcaccagggctgcctccctccgttcccagcggacgtgttcatgattcctcagtacgggtatctgacactcaacaacggcagtcaggcagtgggacggtcatccttctactgcctggaatattttccatcgcagatgctgagaaccggcaacaactttccgttcagttacaccttcgaggacgtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 15 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagaacagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccaggactgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 16 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggtgccgacggagtgggtaatgcctcaggaaattggcattgcgattccacatggctgggcgactgagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacgctcaacaatggcagccaggcagtgggacggtcatccttttactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatactcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 17 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtacttcaacgggggccagtaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 18 - DNA, 2208 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccggcagctcgacagcggagacaacccgtacctgcggtataaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaacagattccactgccacttttcaccacgtgactggcaaagactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctccctccgttcccggcggacgtgttcatgattccgcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcactggctaatcctggcatcgctatggcaacacacaaagacgacaggagcgtttttttccagtaccgggatcctgattttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 19 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcagccctcgaacacgacaaagcttacgaccagcagctcaaggccggtgacaacccctacctcaagtataaccacgccgacgccgagtttcaggagcgtcttcaaggagatacgtcttttgggggcaacctcggacgagcagtcttccaggccaagaagcgggttctcgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccttgggggtattttgacttcaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctccctccgttcccggcggacgtgttcatgattccgcagtacggctacctaacgctcaacaatggcagccaggcagtgggacggtcatccttttactgcctggaatactttccttcgcagatgctgagaaccggcaacaacttccagtttacttacaccttcgaggacgtgcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtagcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 20 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggacaaaataccatctgaatggaagaaattcattggctaatcctggcatcgctatggcaacacacaaagacgacaaggagcgtttttttcccagtaacgggattctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggacttaagcacccgcctcctcagatcctcatcaaaaacacgcctgttcctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 21 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggatgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 22 - DNA, 2214 bp, Artificial
  Recombinant AAV capsid clone coding sequence
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcaccagaacctgggccttgcccacctacaataaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccgacccaagagactcaacttcaagctcttcaacatccaggtcaaggaggtcacgcagaacgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcactcgttacctcacccgtcccctgtaa

SEQ ID NO: 23 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcagccctcgaacacgacaaagcttacgaccagcagctcaaggccggtgacaacccctacctcaagtataaccacgccgacgccgagtttcaggagcgtcttcaaggagatacgtcttttgggggcaacctcggacgagcagtcttccaggccaagaagcgggttctcgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccttgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttgacaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggatgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 24 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggcgactcagagtcagtccccgacccacaacctctcggagaacctccagcaacccccgctgctgtgggacctaatacgatggctacaggcagtggcgcaccaatggcagacaataacgagggcgccgacggagtgggtaattcctcgggaaattggcattgcgattccacatggatgggcgacagagtcatcaccaccagcaccagaacctgggccctgcccacttacaacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcaccatccaggtctttacggactcggaataccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcaaggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 25 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacgggaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 26 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagaggcctgtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacatccaggtcaaggaggtcacgcagaatgaaggcaccaagaccatcgccaataacctcaccagcaccatccaggtgtttacggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 27 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggctgcaggcggtggcgcaccaatggcagacaataacgaaggcgccgacggagtgggtagttcctcgggaaattggcattgcgattccacatggatgggcgacagagtcatcaccaccagcacccgaacctgggccttgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagcttggaccggctgatgaatcctctgattgaccagtacctgtactacttgtctcggactcaaacaacaggaggcacggcaaatacgcagactctgggtttcagccaaggtgggcctaatacaatggccaatcaggcaaagaactggctgcaaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaacctggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 28 - DNA, 2214 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggagagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattcccaatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgctcacagccagagcttggaccggctgatgaatcctctgattgaccagtacctgtactacttgtctcggactcaaacaacaggaggcacggcaaatacgcagactttgggcttcagccaaggtgggcctaatacaatggccaatcaggcaaagaactgggtgccaggaccctgttaccgccaacaacgggtttcaacggcaaccgggcaaaacaacaatagcaactttgcctggactgctgggaccaaataccatctgaaaggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaaacgctggaacccagagattcaatacacttccaactactacaaatctacaagtgtggactttgctgttaatacagaaggcgtgtactctgaaccccaccccattggcacccgttacctcacccgtcccctgtaa

SEQ ID NO: 29 - DNA, 2214 bp, Artificial
  Recombinant AAV capsid clone coding sequence
  misc_feature (676)..(676): n is a, c, g, or t
  misc_feature (697)..(697): n is a, c, g, or t
  misc_feature (715)..(715): n is a, c, g, or t
  misc_feature (748)..(748): n is a, c, g, or t
  misc_feature (750)..(750): n is a, c, g, or t
  misc_feature (757)..(757): n is a, c, g, or t
  misc_feature (763)..(763): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacgccctctggtgtgggacctaatacaatggctgcaggcggtggcgctccaatggcagacaataacgaaggcgccgacggagtgggtagttcctcangaaattggcattgcgattccncatggctgggcgacagantcatcaccaccagcacccgaacctgggccctgncnacctacnacaacnacctctacaagcaaatctccaacagcacatctggaggagccaccaacgacaacacctacttcggctacagcaccccctgggggtattttgactttaacagattccactgccacttttcaccacgtgactggcagcgactcatcaacaacaactggggattccggcctaagcgactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcaatacagcacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 30 - DNA, 2214 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacggacaatgatggagtcaagaccatcgccaataaccttaccagcacgattcaggtctttacggactcggaataccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 31 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 32 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctccaagcgggtgacaatccgtacctgcggtataaccacgccgacgccgagtttcaggagcgtcttcaaggagatacgtcttttgggggcaacctcggacgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 33 - DNA, 2217 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgcggagtttcaggagcgccttaaagaagatacgtcttttgggggcaacctcggacgagcagtcttccaggcgaaaaagagggttcttgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattcccaatggctgggggacagagtcatcaccaccagcaccagaacctgggccctgcccacctacaacaatcacctctacaagcaaatctccaacagcacatctggaggatcttcaaatgacaacgcctacttcggctacagcaccccctgggggtattttgacttcaaccgcttccactgccacttctcaccacgtgactggcagcgactcatcaacaacaactggggattccggcccaagagactcaacttcaagctcttcaacattcaggtcaaagaggttacggacaacaatggagtcaagaccatcgccaataaccttaccagcacggtccaggtctttacggactcggagtaccagttgccgtacgtcctcggctctgcgcaccagggctgcctccctccgttcccggcggacgtgttcatgattccccagtacggctacctaacactcaacaacggtagtcaggccgtgggacgctcctccttctactgcctggaatatttcccttctcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggcaaagattccacacacggacggacattttcacccctctcccctcatgggtggattcggacttaaacaccctcctccacagattctcatcaagaacaccccggtacctgcgaatcctccgaccaccttcaaccagtcaaagctgaactctttcatcacgcaatacagcacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 34 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaaggggctaagacggctcctggaaagaaacgtccggtagagcagtcgccacaagagccagactcctcctcgggcattggcaagacaggccagcagcccgctaaaaagagactcaactttgggcagactggcgactcagagtcagtgcccgatcctcaacctctcggagaacctccagcaacccccgctgctgtgggacctactacaatggcttcaggcggtggcgcaccaatggcggacaataacgaaggcgccgatggagtgggtaattcctcgggaaattggcattgcgattccacatggatgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccatttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcattattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgccagtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 35 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagagggttcttgaaccttttggtctggttgaggaagctgctaagacggctcctggaaagaaacgtccggtagagcagtcgccacaagagccagactcctcctcgggcattggcaagacaggccagcagcccgctaaaaagagactcaattttggtcagactggcgactcagagtcagtgcccgaccctcaacctctcggagaacctccagcaacccccgctgctgtgggacctactacaatggcttcaggcggtggcgcaccaatggcagacaataacgaaggcgccgatggagtgggtaatgcctcaggaaattggcattgcgattccacatggctgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccattcaggtctttacggattcggaataccagctcccgtacgtcctcggctctgcccaccagggctgcctccctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 36 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagcccgtcaacgaggcggacgcggcggccctcgaacacgacaaggcttacgaccagcagctcaaggccggtgacaacccctacctgcggtacaaccacgccgacgccgagttccaggagcggctgcaagaagatacgtcttttgggggcaacctcgggcgagcagtcttccaggccaagaagaggcttcttgaacctcttggtctggttgaggaagcggctaagacggctcctggaaagaagaggcctgtagagcagtctcctcaggaaccggactcctccgcgggtattggcaaatcaggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgatggagtgggtaatgcctcaggaaattggcattgcgattccacatggctgggcgacagagtcatcaccaccagcacccgaacctgggccctgcccacctataacaaccatctctacaagcaaatctccagtgcttcaacgggggccagtaacgacaaccactacttcggctacagcaccccctgggggtattttgactttaacagattccactgccacttctcaccacgtgactggcagcgactcatcaacaacaactggggattccggcccaagcgactcaacttcaagctcttcaacattcaggtcaaagaggttacggacaacgatggagtcaagaccatcgccaataaccttaccagcaccattcaggtgtttacggactcggaataccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaactggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 37 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttgggtctggttgaggaaggggctaagacggctcctggaaagaaaaggccggtagagcagtctcctcaggaaccggactcctccgcgggtattggcaagacaggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagtgcctcgggaaattggcattgcgattccacatggctgggcgacagagtcatcaccaccagcacccgaacctgggccctgcccacctataacaaccatctctacaagcaaatctccagtgcttcaacgggggccagtaacgacaaccactacttcggctacagcaccccctgggggtattttgacttcaacagattccactgccacttctcaccacgtgactggcagcgactcatcaacaacaactggggattccggcccaagcgactcaacttcaagctcttcaacattcaggtcaaagaggttacggacaacaatggagtcaagaccatcgccaataaccttaccagcacgatccaggtctttacggactcggagtaccagctgccgtacgtcctcggctctgcgcaccagggctgcctgcctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 38 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctataacaaccacctctacaagcaaatctccagtgcttcaacgggggccagcaacgacaaccactactttggctacagcaccccttgggggtattttgacttcaacagattccactgccacttttcaccacgtgactggcaaagactcatcaacaacaactggggattccgacccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 39 - DNA, 2214 bp, Artificial
  Recombinant AAV capsid clone coding sequence
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcaccagaacctgggccttgcccacctacaataaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccgacccaagagactcaacttcaagctcttcaacatccaggtcaaggaggtcacgcagaacgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 40 - DNA, 2214 bp, Artificial
  Recombinant AAV capsid clone coding sequence
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctggggaacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcccaagagactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcaatacggctacctgacgctcaacaacggtagccaagccgtgggacgttcatccttttactgcctggaatatttcccttctcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 41 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaggggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 42 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctcccgcagccccctcaggtgtgggatctcttacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacttacaacaaccatctctacaagcaaatctccagtgcttcaacgggggccagcaacgacaaccactacttcggctacagcaccccctgggggtattttgatttcaacagattccactgccacttttcaccacgtgactggcaaagactcatcaacaacaactggggattccgacccaagagactcaacttcaagctctttaacattcaagtcaaagaggtcacgcagaatgaaggcaccaagaccatcgccaataaccttaccagcacggtccaggtcttcacggactcagactatcagctcccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctggaaccaaataccatctgaatggaagaaattcattgtctaatcctggcatcgctatggcgacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacatgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 43 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaggaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgacccacaacctctcggagaacctccagcaacccccgctgctgtgggacctactacaatggctgcaggcggtggcgcaccaatggcagacaataacgaaggcgccgacggagtgggtagttcctcgggaaattggcattgcgattccacatggctgggcgacagagtcatcaccaccagcaccagaacctgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaaactcttcaacattcaggtcaaagaggttacggacaacaatggagtcaagaccatcgccaataaccttaccagcacggtccaggtgtttacggactcggagtaccagctgccgtacgttctcggctctgcccaccagggctgcctccctccgttcccggcggacgtgttcatgattccgcagtacggctacctaacgctcaacaatggcagccaggcagtgggacggtcatccttttactgcctggaatatttcccttctcagatgctgagaacgggcaacaactttaccttcagctacacctttgaggaagtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcctcacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 44 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 45 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKATNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 46 - protein, 737 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGANTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMASHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTTNYYKSTSVDFAVNTEGVYSEPHPIGTRYLTRPL

SEQ ID NO: 47 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 48 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 49 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRNL

SEQ ID NO: 50 - protein, 738 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 51 - protein, 737 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMQDNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 52 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 53 - protein, 737 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNLGSRPKRLNFKLFIIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 54 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSSGIGKTGQQPAKKRLNFGQTGDSESVPDPQPIGEPPATPAAVGPTTMASGGGAPMADNNEGADGVGNSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSDPHPIGTRYLTRPL

SEQ ID NO: 55 - protein, 736 aa, Artificial
  Recombinant AAV capsid clone amino acid sequence
MAADGYLPDWLEDNLSEGIREWWALKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFFCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 56 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQNSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTVPRPIGTRYLTRPL

SEQ ID NO: 57 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEGAKTAPGKKRPVEQSPQEPDSSSGIGKTGEQPAKKRLNFGQTGDSESVPDPQPLGEPPATPAAVGPTTMASGGGAPMADNNEGADGVGSASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFPFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 58 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQDCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 59 - protein, 735 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVILTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 60 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 61 - protein, 735 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDRQLDSGDNPYLRYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDRSVFFQYRDPDFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 62 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPLGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 63 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEAAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 64 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 65 - protein, 737 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 66 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPLGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFDKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 67 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDSESVPDPQPLGEPPATPAAVGPNTMATGSGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGKANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 68 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTGNTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 69 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 70 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMAAGGGAPMADNNEGADGVGSSSGNWHCDSTWMGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLQGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNLDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 71 - protein, 737 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSSGIGKTGQQPAKKRLNFGQTGDSESVPDPQPLGEPPATPAAVGPTTMASGGGAPMADNNEGADGVGNASGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWVPGPCYRQQRVSTATGQNNNSNFAWTAGTKYHLKGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 72 - protein, 737 aa, Artificial
  Recombinant AAV capsid clone amino acid sequence
  misc_feature (226)..(226): Xaa can be any naturally occurring amino acid
  misc_feature (233)..(233): Xaa can be any naturally occurring amino acid
  misc_feature (239)..(239): Xaa can be any naturally occurring amino acid
  misc_feature (250)..(250): Xaa can be any naturally occurring amino acid
  misc_feature (253)..(253): Xaa can be any naturally occurring amino acid
  misc_feature (255)..(255): Xaa can be any naturally occurring amino acid
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPSGVGPNTMAAGGGAPMADNNEGADGVGSSSXNWHCDSXWLGDRXITTSTRTWALXTYXNXLYKQISNSTSGGATNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEVQYTSNYAKSANVDFTVDNNGLYTEPRPIGTRYLTRPL

SEQ ID NO: 73 - protein, 737 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNDGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 74 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 75 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQGDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 76 - protein, 738 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNAADAAALEHDKAYDQQLKAGDNPYLRYNHADAEFQERLKEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGHFHPSPLMGGFGLKHPPPQILIKNTPVPANPPTTFNQSKLNSFITQYSTGQVSVEIEWELQKENSKRWNPEVQYTSNYAKSANVDFTVDNNGLYTEPRPIGTRYLTRPL

SEQ ID NO: 77 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFIIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 78 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEAAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 79 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNDGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 80 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSAGIGKTGAQPAKKRLNFGQTGDSESVPDPQPLGEPPATPAAVGPTTMASGGGAPMADNNEGADGVGSASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 81 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 82 - protein, 737 aa, Artificial; identical to SEQ ID NO: 65
  Recombinant AAV capsid clone amino acid sequence

SEQ ID NO: 83 - protein, 737 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGSSSGNWHCDSQWLGNRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 84 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDRGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 85 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLSNPGIAMATHKDDKERFFPSNGILIFGKQNAARDNADYSDVMLTSEEEIKTTNPVATEEYGIVADNLQQQNTAPQIGTVNSQGALPGMVWQNRDMYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 86 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGGSESVPDPQPLGEPPATPAAVGPTTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMASHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 87 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcaacttcaggctcttcaacattcaggtcaaagaggttacggacaacaatggagtcaagaccatcgccaataaccttaccagcacggtccaggtcttcacggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 88 - DNA, 2211 bp, Artificial
  Recombinant AAV capsid clone coding sequence
atggctgccgatggttatcttccagattggctcgaggacaacctctctgagggcattcgcgagtggtgggacttgaaacctgcatccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgccaaaaagagactcaatttcggtcagactggcggcacagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcaccagaacctgggccctgcccacttacaacaaccatctctacaagcaaatctccagtgcttcaacgggggccagcaacgacaaccactacttcggctacagcaccccctgggggtattttgatttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggatacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 89 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattcccaatggctgggggacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 90 - DNA, 2211 bp, Artificial
  Recombinant AAV capsid clone coding sequence
atggctgccgatggttatcttccagattggctcgaggacaacctctctgagggcattcgcgagtggtgggacttggaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacaggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 91 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagtctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgattttcggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcaccagatacctgactcgtaatctgtaa

SEQ ID NO: 92 - DNA, 2208 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctg

SEQ ID NO: 93 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccagcagctccaagcgggtgacaatccgtacctgcggtataaccacgccgacgccgagtttcaggagcgtcttcaaggagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaaccgcttccactgccacttctcaccacgtgactggcagcgactcatcaacaacaactggggattccggcccaagagactcagcttcaagctcttcaaccatccaggtcaaggaggtcacgcagaatgaaggcaccaagaccatcgccaataacctcaccagcacatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagttcacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattgggtaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctcatcaaaaacacacctgtacctgcggatcctccaacggccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 94 - DNA, 2214 bp, Artificial
  Recombinant AAV capsid clone coding sequence
atggctgccgatggttatcttccagattggctcgaggacaacctctctgagggcattcgcgagtggtgggacttgaaacatggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgatccccaccccattggcacccgttacctcacccgtcccctgtaa

SEQ ID NO: 95 - DNA, 2214 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgccagaaaaagactcaattttggtcagactggcgactcagagtcagttccagaccctcaacctctcggagaacctccagcagcgccctctggtgtgggacctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 96 - DNA, 2211 bp, Artificial
  Recombinant AAV capsid clone coding sequence
  misc_feature (676)..(676): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcangaaattggcattgcgattccacatggctgggcgacagagtcatcaccaccagcacccgaacatgggccttgccacctataacaaccacctctacaagcaaatctccagtgcttcaacgggggcgcagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 97 - DNA, 2211 bp, Artificial
  Recombinant AAV capsid clone coding sequence
  misc_feature (715)..(715): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctccaagcgggtgacaatccgtacctgcggtataaccacgccgacgccgagtttcaggagcgtcttcaaggagatacgtcttttgggggcaacctcggacgagcagtcttccaggccaagaagcgggttctcgaacctctcggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctctggtgtgggacctaatacaatggctgcaggcggtggcgcaccaatggcagacaataacgaaggcgccgatggagtgggtagttcctcgggaaattggcattgcgattccacatggctgggcgacagantcatcaccaccagcacccgaacctgggccctgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataactttcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 98 - DNA, 2211 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaggccggtgacaacccctacctcaagtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 99 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccagcagctccaagcgggtgacaatccgtacctgcggtataaccacgccgacgccgagtttcaggagcgtcttcaaggagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaaccgcttccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 100 - DNA, 2217 bp, Artificial
  Recombinant AAV capsid clone coding sequence
atggctgccgatggttatcttccagattggctcgaggacaacctctctgagggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggggacagagtcatcaccaccagcacccgaacctgggccctgcccacctacaacaaccacctctacaagcaaatctccaacgggacttcgggaggaagcaccaacgacaacacctacttcggctgcgtcacgccctgggggtattttgactttaacaaattccactgccacttttcaccggatgactggcaacgactcatcaacaacggctggggattccggactaagcgactcaacttcaagctcttcagcatgaaagtcaaaaagggtacggacaacactggaatcaagaccatcgcgaataaccttaccaacacggtccatgtcttcgcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacctccaactactacaaatctacaagtgtggactttgctgttaatacagaaggcgtgtactctgaaccccaccccattggcacccgttacctcacccgtcccctgtaa

SEQ ID NO: 101 - DNA, 2214 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgatggagtgggtagttcctcgggaaattggcattgcgattccacatggctgggggacagagtcatcaccaccagcacccgaacctgggccctgcccacctacaacaaccacctctacaaacaaatttccagcgcttcaacgggagcctcgaacgacaatcactactttggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacctgcagcagcaaaacacggctcctcaaattggaactgtcaacagccagggggccttacccggtatggtctggcagaaccgggacgtgtacctgcagggtcccatctgggccaagattcttcacacggacggcaactttcacccttctccgctgatgggagggtttggaatgaagcacccgcctcctccgatcctgatcaagaacacgcctgtacctgcggatcctccgaccaccttcaaccagtcaaagctgaactctttcatcacgcaatacagcaccggacaggtcagcgtggaaattgaatgggagctgccgaaggaaaacagcaagcgctggaaccccgagatccagtacacctccaactactacaaatctacaagtgtggactttgctgttaatacagaaggtgtgtactatgaaccccaccccattggcacccgttacctcacccctcccctgtaa

SEQ ID NO: 102 - DNA, 2214 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgctctccagactcctctacgggcatcggcaagaaaggccaacagcccgccagaaaaagactcaattttggtcagactggcgactcagagtcagttccagaccctcaacctctcggagaacctccagcagcgccctctggtgtggcacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcacaacaattgggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 103 - DNA, 2211 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcctaagcgactcaacttcaagctcttcaacattcaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgatcccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggcttcggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 104 - DNA, 2214 bp, Artificial
  Recombinant AAV capsid clone coding sequence
atggctgccgatggttatcttccagattggctcgaggacaacctctctcagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgcccgctgctgtgggacctactacaatggcttcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacgggtacctgactctgaacaatggcagtcaggccgtgggccgttcctccttctactgcctggagtactttccttctcaaatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatgcgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 105 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggacctaatacaatggctgcaggcggtggcgcaccaatggcagacaataacgaaggcgccgacggagtgggtagttcctcgggaaattggcattgcgattccacatggatgggtgacagagtcatcaccaccagcacccgaacctgggccctgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacttcacccgtcccctgtaa

SEQ ID NO: 106 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaaaagactcaattttggtcagactggcgactcagagtcagttccagaccctcaacctctcggagaacctccagcaacccccgctgctgtgggacctactacaatggcttcaggtggtggcgcaccaatggcagacaataacgagggcgccgacggagtgggtaattcctcgggaaattggcattgcgattccacatggatgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcgacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 107 - DNA, 2211 bp, Artificial
  Recombinant AAV capsid clone coding sequence
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctgactctgaacaatggcagtcaggccgtgggccgttcctccttctactgcctagagtactttccttctcaaatgctgagaacgggcaacaactttgagttcagctaccagtttgaggacgtgccttttcacagcagctacgcgcacagccaaagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatatgaatggaagaaattcattggttaatcctggcatcgctatggcaacacacaaagacgacaaggagcgtttttttcccagtaacgggatcctgatttttggcaaacaaaatgttgccagagacaatgcggattacagcgatgtcatgctcaccagcgaggaagaaatcaaaaccactaaccctgtggctacagaggaatacggtattgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtcgccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 108 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFRLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 109 - protein, 736 aa, Artificial
  Recombinant AAV capsid clone amino acid sequence
MAADGYLPDWLEDNLSEGIREWWDLKPASPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGGTESVPDPQPLGEPPAAPSGVGPNTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 110 - protein, 736 aa, Artificial; identical to SEQ ID NO: 49
  Recombinant AAV capsid clone amino acid sequence

SEQ ID NO: 111 - protein, 736 aa, Artificial
  Recombinant AAV capsid clone amino acid sequence
MAADGYLPDWLEDNLSEGIREWWDLEPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 112 - protein, 736 aa, Artificial; identical to SEQ ID NO: 49
  Recombinant AAV capsid clone amino acid sequence

SEQ ID NO: 113 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 114 - protein, 734 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDQQLQAGDNPYLRYNHADAEFQERLQGDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNHPGQGGHAERHQDHRQPHQHIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLGNPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTAFNQSKLNSFITQYSTGQVSVEIEWELQKENSKRWNPEIQYTSNYYKSTSVDFAVNTEGVYSEPHPIGTRYLTRPL

SEQ ID NO: 115 - protein, 737 aa, Artificial
  Recombinant AAV capsid clone amino acid sequence
MAADGYLPDWLEDNLSEGIREWWDLKHGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSDPHPIGTRYLTRPL

SEQ ID NO: 116 - protein, 737 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 117 - protein, 736 aa, Artificial
  Recombinant AAV capsid clone amino acid sequence
  misc_feature (226)..(226): Xaa can be any naturally occurring amino acid
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASXNWHCDSTWLGDRVITTSTRTWALPPITTTSTSKSPVLQRGRSNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 118 - protein, 736 aa, Artificial
  Recombinant AAV capsid clone amino acid sequence
  misc_feature (239)..(239): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLQAGDNPYLRYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGPNTMAAGGGAPMADNNEGADGVGSSSGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNFQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 119 - protein, 736 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNEADAAALEHDKAYDQQLKAGDNPYLKYNHADAEFQERLQEDTSFGGNLGRAVFQAKKRLLEPLGLVEEAAKTAPGKKRPVEQSPQEPDSSAGIGKSGAQPAKKRLNFGQTGDTESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 120 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDQQLQAGDNPYLRYNHADAEFQERLQGDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 121 - protein, 738 aa, Artificial
  Recombinant AAV capsid clone amino acid sequence
MAADGYLPDWLEDNLSEGIRQWWKLKPGPPPPKPAERHKDDSRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISNGTSGGSTNDNTYFGCVTPWGYFDFNKFHCHFSPDDWQRLINNGWGFRTKRLNFKLFSMKVKKGTDNTGIKTIANNLTNTVHVFADSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 122 - protein, 737 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKILHTDGNFHPSPLMGGFGMKHPPPPILIKNTPVPADPPTTFNQSKLNSFITQYSTGQVSVEIEWELPKENSKRWNPEIQYTSNYYKSTSVDFAVNTEGVYYEPHPIGTRYLTPPL

SEQ ID NO: 123 - protein, 737 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVAPNTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLITTIGGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 124 - protein, 736 aa, Artificial
  Recombinant AAV capsid clone amino acid sequence
MAADGYLPDWLEDTLSEGIRQWWKLKPGPPPPKPAERHKDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 125 - protein, 737 aa, Artificial
  Recombinant AAV capsid clone amino acid sequence
MAADGYLPDWLEDNLSQGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNAQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 126 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDTESVPDPQPIGEPPAAPSGVGPNTMAAGGGAPMADNNEGADGVGSSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYFTRPL

SEQ ID NO: 127 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 128 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHMNGRNSLVNPGIAMATHKDDKERFFPSNGILIFGKQNVARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 129 - DNA, 2214 bp, Artificial
  Recombinant AAV capsid clone coding sequence
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 130 - protein, 737 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 131 - protein, 736 aa, Artificial
  Recombinant AAV capsid clone amino acid sequence
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 132 - protein, 736 aa, Artificial
  Recombinant AAV capsid clone amino acid sequence
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 133 - DNA, 2217 bp, Artificial
  Recombinant AAV capsid clone coding sequence
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 134 - protein, 738 aa, Artificial
  Recombinant AAV capsid clone amino acid sequence
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 135 - DNA, 35 bp, Artificial
  Mutagenesis primer sequence
gggaaaaaaacgctccttgtcgtctttgtgtgttg

SEQ ID NO: 136 - DNA, 35 bp, Artificial
  Mutagenesis primer sequence
caacacacaaagacgacaaggagcgtttttttccc

SEQ ID NO: 137 - DNA, 20 bp, Artificial
  Mutagenesis primer sequence
aatgtggatttggatgactg

SEQ ID NO: 138 - DNA, 49 bp, Artificial
  Mutagenesis primer sequence
cgttattgtctgccattggtgcgccaccgcctgcagccattgtaagaga

SEQ ID NO: 139 - DNA, 41 bp, Artificial
  Mutagenesis primer sequence
accaatggcagacaataacgaaggcgccgacggagtgggta

SEQ ID NO: 140 - DNA, 16 bp, Artificial
  Mutagenesis primer sequence
agagccgagaacgtac

SEQ ID NO: 141 - DNA, 23 bp, Artificial
  qPCR primer sequence
agcagcacgacttcttcaactcc

SEQ ID NO: 142 - DNA, 24 bp, Artificial
  qPCR primer sequence
tgtagttgtactccagcttgtgcc

SEQ ID NO: 143 - DNA, 23 bp, Artificial
  qPCR primer sequence
gttaacactcaggcgcatgggcc

SEQ ID NO: 144 - DNA, 23 bp, Artificial
  qPCR primer sequence
ccatcagggtcacctctggttcc

SEQ ID NO: 145 - DNA, 25 bp, Artificial
  qPCR primer sequence
aacatgctacgcagagagggagtgg

SEQ ID NO: 146 - DNA, 29 bp, Artificial
  qPCR primer sequence
catgagacaaggaacccctagtgatggag

We claim:

1. A method of delivering a nucleic acid of interest to a CNS cell, the method comprising contacting the cell with an AAV particle comprising:
   an AAV vector genome; and
   an AAV capsid protein comprising the amino acid sequence of SEQ ID NO: 56 and wherein up to 1 amino acid of said amino acid sequence is substituted, wherein the AAV capsid encapsidates the AAV vector genome.

2. A method of delivering a nucleic acid of interest to a CNS cell in a mammalian subject, the method comprising:
   administering to a mammalian subject an effective amount of an AAV particle comprising:
   an AAV vector genome; and
   an AAV capsid protein comprising the amino acid sequence of SEQ ID NO: 56 and wherein up to 1 amino acid of said amino acid sequence is substituted, wherein the AAV capsid encapsidates the AAV vector genome.

3. A method of delivering a nucleic acid of interest to an area of the CNS bordering a compromised blood brain barrier area in a mammalian subject, the method comprising:
   intravenously administering to a mammalian subject an effective amount of an AAV particle comprising:
   an AAV vector genome; and
   an AAV capsid protein comprising the amino acid sequence of SEQ ID NO; 56 and wherein up to 1 amino acid of said amino acid sequence is substituted, wherein the AAV capsid encapsidates the AAV vector genome.

4. A method of treating a disorder associated with CNS dysfunction in a mammalian subject in need thereof, the method comprising administering to a mammalian subject a therapeutically effective amount of an AAV particle comprising:
   an AAV vector genome; and
   an AAV capsid protein comprising the amino acid sequence of SEQ ID NO: 56 and wherein up to 1 amino acid of said amino acid sequence is substituted, wherein the AAV capsid encapsidates the AAV vector genome.

5. The method of claim 1, wherein the substitution is in the VP3 portion of the AAV capsid protein.

6. The method of claim 1, wherein the AAV vector genome comprises a heterologous nucleic acid.

7. The method of claim 6, wherein the heterologous nucleic acid is a cystic fibrosis transmembrane regulator gene.

8. The method of claim 6, wherein the heterologous nucleic acid is operably linked to a constitutive promoter.

9. The method of claim 7, wherein the heterologous nucleic acid is operably linked to a constitutive promoter.

10. The method of claim 2, wherein the substitution is in the VP3 portion of the AAV capsid protein.

11. The method of claim 2, wherein the AAV vector genome comprises a heterologous nucleic acid.

12. The method of claim 11, wherein the heterologous nucleic acid is a cystic fibrosis transmembrane regulator gene.

13. The method of claim 11, wherein the heterologous nucleic acid is operably linked to a constitutive promoter.

14. The method of claim 12, wherein the heterologous nucleic acid is operably linked to a constitutive promoter.

15. The method of claim 3, wherein the substitution is in the VP3 portion of the AAV capsid protein.

16. The method of claim 3, wherein the AAV vector genome comprises a heterologous nucleic acid.

17. The method of claim 16, wherein the heterologous nucleic acid is a cystic fibrosis transmembrane regulator gene.

18. The method of claim 16, wherein the heterologous nucleic acid is operably linked to a constitutive promoter.

19. The method of claim 17, wherein the heterologous nucleic acid is operably linked to a constitutive promoter.

20. The method of claim 4, wherein the substitution is in the VP3 portion of the AAV capsid protein.

21. The method of claim 4, wherein the AAV vector genome comprises a heterologous nucleic acid.

22. The method of claim 21, wherein the heterologous nucleic acid is a cystic fibrosis transmembrane regulator gene.

23. The method of claim 21, wherein the heterologous nucleic acid is operably linked to a constitutive promoter.

24. The method of claim 22, wherein the heterologous nucleic acid is operably linked to a constitutive promoter.

* * * * *

UNITED STATES PATENT AND TRADEMARK OFFICE
CERTIFICATE OF CORRECTION

Page 1 of 1

PATENT NO. : 10,532,110 B2
APPLICATION NO. : 15/525214
DATED : January 14, 2020
INVENTOR(S) : Gray et al.

It is certified that error appears in the above-identified patent and that said Letters Patent is hereby corrected as shown below:

In the Specification

Column 13, Line 41:
Please correct "$4%" to read -- 84% --

Column 59, Line 63:
Please correct "(n=12 25)" to read -- (n=12-25) --

In the Claims

Column 67, Line 41, Claim 3:
Please correct "SEQ ID NO; 56" to read -- SEQ ID NO: 56 --

Signed and Sealed this
Second Day of June, 2020

Andrei Iancu
*Director of the United States Patent and Trademark Office*